(12) United States Patent
Suri et al.

(10) Patent No.: US 11,629,340 B2
(45) Date of Patent: Apr. 18, 2023

(54) DHFR TUNABLE PROTEIN REGULATION

(71) Applicant: OBSIDIAN THERAPEUTICS, INC., Cambridge, MA (US)

(72) Inventors: Vipin Suri, Belmont, MA (US); Dan Jun Li, Cambridge, MA (US); Dexue Sun, Cambridge, MA (US); Byron Delabarre, Arlington, MA (US); Vijaya Balakrishnan, Groton, MA (US); Brian Dolinski, Cambridge, MA (US); Mara Christine Inniss, Beverly, MA (US); Grace Y. Olinger, Cambridge, MA (US)

(73) Assignee: OBSIDIAN THERAPEUTICS, INC., Cambridge, MA (US)

( * ) Notice: Subject to any disclaimer, the term of this patent is extended or adjusted under 35 U.S.C. 154(b) by 571 days.

(21) Appl. No.: 16/558,224

(22) Filed: Sep. 2, 2019

(65) Prior Publication Data

US 2020/0172879 A1    Jun. 4, 2020

Related U.S. Application Data

(63) Continuation of application No. PCT/US2018/020718, filed on Mar. 2, 2018, which is a continuation of application No. PCT/US2018/020741, filed on Mar. 2, 2018, which is a continuation of application No. PCT/US2018/020755, filed on Mar. 2, 2018, which is a continuation of application No. PCT/US2018/020768, filed on Mar. 2, 2018, which is a continuation of application No. PCT/US2018/020704, filed on Mar. 2, 2018.

(60) Provisional application No. 62/542,400, filed on Aug. 8, 2017, provisional application No. 62/484,047, filed on Apr. 11, 2017, provisional application No. 62/466,603, filed on Mar. 3, 2017, provisional application No. 62/484,052, filed on Apr. 11, 2017, provisional application No. 62/466,601, filed on Mar. 3, 2017, provisional application No. 62/484,062, filed on Apr. 11, 2017, provisional application No. 62/555,316, filed on Sep. 7, 2017, provisional application No. 62/484,060, filed on Apr. 11, 2017, provisional application No. 62/555,328, filed on Sep. 7, 2017, provisional application No. 62/484,063, filed on Apr. 11, 2017, provisional application No. 62/542,402, filed on Aug. 8, 2017.

(51) Int. Cl.
| | |
|---|---|
| *C12N 15/85* | (2006.01) |
| *C07K 14/54* | (2006.01) |
| *A61K 35/17* | (2015.01) |
| *C12N 9/06* | (2006.01) |
| *C07K 14/715* | (2006.01) |
| *C07K 14/705* | (2006.01) |

(52) U.S. Cl.
CPC .............. *C12N 9/003* (2013.01); *A61K 35/17* (2013.01); *C07K 14/5434* (2013.01); *C07K 14/5443* (2013.01); *C07K 14/70503* (2013.01); *C07K 14/7155* (2013.01); *C12N 15/85* (2013.01); *C12Y 105/01003* (2013.01); *C07K 2319/30* (2013.01); *C07K 2319/33* (2013.01)

(58) Field of Classification Search
CPC ................... C12N 9/003; C12N 15/85; C12Y 105/01003; C07K 14/54; A61K 35/17
See application file for complete search history.

(56) References Cited

U.S. PATENT DOCUMENTS

| | | | | |
|---|---|---|---|---|
| 6,642,043 B1 * | 11/2003 | Bertino | .................. | C12N 9/003 435/189 |
| 2004/0053836 A1 * | 3/2004 | Mayer-Kuckuk | ...... | C12N 9/003 435/69.7 |
| 2006/0160104 A1 | 7/2006 | Johnson et al. | | |
| 2006/0211007 A1 * | 9/2006 | Cornish | ............... | G01N 33/573 435/7.1 |
| 2007/0254338 A1 * | 11/2007 | Caspary | .................. | C12P 21/02 435/191 |
| 2008/0280830 A1 | 11/2008 | Choi et al. | | |
| 2009/0042251 A1 | 2/2009 | Scholz et al. | | |
| 2009/0215169 A1 * | 8/2009 | Wandless | ............... | C12N 15/62 435/325 |
| 2010/0047205 A1 | 2/2010 | Hadden et al. | | |
| 2012/0115128 A1 * | 5/2012 | Miller | ...................... | C07K 1/13 435/6.1 |
| 2013/0266551 A1 | 10/2013 | Campana et al. | | |
| 2014/0010791 A1 | 1/2014 | Wandless et al. | | |
| 2015/0307564 A1 | 10/2015 | Young et al. | | |
| 2016/0122707 A1 | 5/2016 | Swee et al. | | |
| 2016/0272718 A1 * | 9/2016 | Wang | .................. | C07K 16/2887 |
| 2017/0157176 A1 | 6/2017 | Wang et al. | | |
| 2017/0296678 A1 | 10/2017 | Frost et al. | | |

FOREIGN PATENT DOCUMENTS

| | | |
|---|---|---|
| WO | 2005012493 | 2/2005 |
| WO | 2011062962 | 5/2011 |
| WO | 2012079000 | 6/2012 |

(Continued)

OTHER PUBLICATIONS

GenBank XP_009447211 (Jun. 2, 2016).*

(Continued)

*Primary Examiner* — Kevin K Hill
(74) *Attorney, Agent, or Firm* — Kilpatrick Townsend & Stockton LLP

(57) ABSTRACT

The present invention is related to compositions and methods for the regulated and controlled expression of proteins.

29 Claims, 72 Drawing Sheets
Specification includes a Sequence Listing.

(56) References Cited

FOREIGN PATENT DOCUMENTS

| WO | 2013059593 | 4/2013 |
|---|---|---|
| WO | 2015007542 | 1/2015 |
| WO | 2015174928 | 11/2015 |
| WO | 2016040395 | 3/2016 |
| WO | 2016048903 | 3/2016 |
| WO | 2016113203 | 7/2016 |
| WO | 2016134284 | 8/2016 |
| WO | 2016210343 | 12/2016 |
| WO | 2017004022 | 1/2017 |
| WO | 2017180587 | 10/2017 |
| WO | 2018023025 | 2/2018 |
| WO | 2018161000 | 9/2018 |

OTHER PUBLICATIONS

Miller et al, Nature Methods 2(4): 255-257, 2005.*
Iwamoto et al, Chemistry & Biology 17: 981-988, 2010.*
Liu et al, PNAS 110(25): 10159-10164, 2013.*
Oefner et al, Eur. J. Biochem. 174: 377-385, 1988.*
Anagnou et al., Chromosomal Localization and Racial Distribution of the Polymorphic Human Dihydrofolate Reductase Pseudogene (DHFRP1), American Journal of Human Genetics, vol. 42, No. 2, Feb. 1988, pp. 345-352.
Anagnou et al., Chromosomal Organization of the Human Dihydrofolate Reductase Genes: Dispersion, Selective Amplification, and a Novel Form of Polymorphism, Proceedings of the National Academy of Sciences, vol. 81, No. 16, Aug. 1, 1984, pp. 5170-5174.
Banaszynski et al., A Rapid, Reversible, and Tunable Method to Regulate Protein Function in Living Cells Using Synthetic Small Molecules, Cell, vol. 126, No. 5, Sep. 8, 2006, pp. 995-1004.
Banaszynski et al., Conditional Control of Protein Function, Chemistry & Biology, vol. 13, No. 1, Jan. 2006, pp. 11-21.
Biotin Biosynthesis; Reaction Prior to Pimeloyl CoA [*Salmonella enterica* Subsp. *Enterica serovar* Typhimurium Str. LT2], GenBank: AAL19733.1, Available Online at: https://www.ncbi.nlm.nih.gov/protein/AAI19733, Accessed from internet on Apr. 18, 2018, pp. 1-2.
Dohmen et al., Heat-Inducible Degron: A Method for Constructing Temperature-Sensitive Mutants, Science, vol. 263, Mar. 4, 1994, pp. 1273-1276.
Egeler et al., Ligand-Switchable Substrates for a Ubiquitin-Proteasome System, The Journal of Biological Chemistry, vol. 286, No. 36, Sep. 9, 2011, pp. 31328-31336.
Kanemaki et al., Functional Proteomic Identification of DNA Replication Proteins by Induced Proteolysis in Vivo, Nature, vol. 423, Jun. 12, 2003, pp. 720-724.
Labib et al., Uninterrupted MCM2-7 Function Required for DNA Replication Fork Progression, Science, vol. 288, Jun. 2, 2000, pp. 1643-1646.
Liu et al., Chemical Rescue of Cleft Palate and Midline Defects in Conditional GSK-3β Mice, Nature, vol. 446, Mar. 1, 2007, pp. 79-82.
Malhotra, Deducing the Essentiality of a Putative Apicoplast Deubiquitinating Protease: The OTU-Like Cysteine Protease PF10_0308 in Plasmodium Falciparum, Research Thesis, Available Online at: https://kb.osu.edu/bitstream/handle/1811/51570/Thesis_Project_Report.pdf?sequence=1&isAllowed=y, Feb. 2012, 33 pages.
Masters et al., A Human Dihydrofolate Reductase Pseudogene and its Relationship to the Multiple Forms of Specific Messenger RNA, Journal of Molecular Biology, vol. 167, No. 1, Jun. 15, 1983, pp. 23-36.
Maurer et al., Assignment of Human Dihydrofolate Reductase Gene to Band Q23 of Chromosome 5 and of Related Pseudogene Ψhd1 to Chromosome 3, Somatic Cell and Molecular Genetics, vol. 11, Jan. 1985, pp. 79-85.
Mesen-Ramirez et al., Stable Translocation Intermediates Jam Global Protein Export in Plasmodium Falciparum Parasites and Link the PTEX Component EXP2 with Translocation Activity, PLOS Pathogens, vol. 12, No. 5, May 11, 2016, 28 pages.
Navarro et al., A Novel Destabilizing Domain Based on a Small-Molecule Dependent Fluorophore, ACS Chemical Biology, vol. 11, No. 8, Aug. 19, 2016, pp. 2101-2104.
Park et al., A Strategy for the Generation of Conditional Mutations by Protein Destabilization, Proceedings of the National Academy of Sciences of the United States of America, vol. 89, Feb. 1992, pp. 1249-1252.
International Application No. PCT/US2018/020704, International Preliminary Report on Patentability dated Sep. 12, 2019, 8 pages.
International Application No. PCT/US2018/020704, International Search Report and Written Opinion dated Jun. 13, 2018, 12 pages.
International Application No. PCT/US2018/020704, Invitation to Pay Additional Fees and Where Applicable, Protest Fee dated Apr. 20, 2018, 2 pages.
International Application No. PCT/US2018/020718, International Preliminary Report on Patentability dated Sep. 12, 2019, 9 pages.
International Application No. PCT/US2018/020718, International Search Report and Written Opinion dated Jun. 22, 2018, 13 pages.
International Application No. PCT/US2018/020718, Invitation to Pay Additional Fees and Where Applicable, Protest Fee dated Apr. 20, 2018, 2 pages.
International Application No. PCT/US2018/020741, International Preliminary Report on Patentability dated Sep. 12, 2019, 11 pages.
International Application No. PCT/US2018/020741, International Search Report and Written Opinion dated Jun. 21, 2018, 15 pages.
International Application No. PCT/US2018/020755, International Preliminary Report on Patentability dated Sep. 12, 2019, 10 pages.
International Application No. PCT/US2018/020755, International Search Report and Written Opinion dated Jun. 25, 2018, 15 pages.
International Application No. PCT/US2018/020768, International Preliminary Report on Patentability dated Sep. 12, 2019, 7 pages.
International Application No. PCT/US2018/020768, International Search Report and Written Opinion dated Jun. 15, 2018, 11 pages.
Rakhit et al., Chemical Biology Strategies for Posttranslational Control of Protein Function, Chemistry & Biology, vol. 21, No. 9, Sep. 18, 2014, pp. 1238-1252.
Shimada et al., A Human Dihydrofolate Reductase Intronless Pseudogene with an Alu Repetitive Sequence: Multiple DNA Insertions at a Single Chromosomal Site, Gene, vol. 31, Nos. 1-3, Nov. 1984, pp. 1-8.
Stankunas et al., Conditional Protein Alleles Using Knockin Mice and a Chemical Inducer of Dimerization, Molecular Cell, vol. 12, No. 6, Dec. 2003, pp. 1615-1624.
Tai et al., Identification of Critical Amino Acid Residues on Human Dihydrofolate Reductase Protein That Mediate RNA Recognition, Nucleic Acids Research, vol. 30, No. 20, Oct. 2002, pp. 4481-4488.
Takeuchi et al., Structural Elements of the Ubiquitin-Independent Proteasome Degron of Ornithine Decarboxylase, Biochemical Journal, vol. 410, No. 2, Mar. 1, 2008, pp. 401-407.
Wallace et al., Highly Divergent Dihydrofolate Reductases Conserve Complex Folding Mechanisms1, Journal of Molecular Biology, vol. 315, No. 2, Jan. 11, 2002, pp. 193-211.
Zhang et al., New Small-Molecule Inhibitors of Dihydrofolate Reductase Inhibit *Streptococcus* Mutans, International Journal of Antimicrobial Agents, vol. 46, No. 2, Aug. 2015, pp. 174-182.

* cited by examiner

DHFR mutant C terminus fusion proteins (without ligand)

MTX or TMP treatment

FIG. 25A

```
hDHFR_WT     121 VYKEAMNHPGHLKLFVTRIMQDFESDTFFPEIDLEKYKLLPEYPGVLSDVQEEKGIKYKF
hDHFR_R138I  121 VYKEAMNHPGHLKLFVTTIMQDFESDTFFPEIDLEKYKLLPEYPGVLSDVQEEKGIKYKF
                 ***************** ******************************************
```

FIG. 25B

```
hDHFR_WT     181 EVYEKND
hDHFR_K185E  181 EVYEEND
                 **** **
```

10μM TMP or 1μM Shield-1

24 hours 48 hours

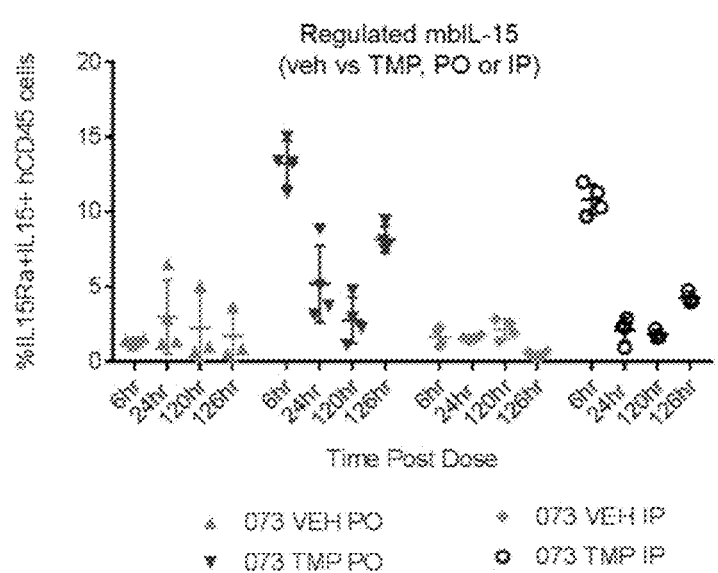

DHFR TUNABLE PROTEIN REGULATION

CROSS REFERENCE TO RELATED APPLICATIONS

This application is a continuation application under 35 U.S.C. § 111(a) claiming the benefit of, and priority (under 35 U.S.C. § 120) to PCT Application No. PCT/US2018/020718, filed on Mar. 2, 2018, which claims priority to U.S. Provisional Application Ser. No. 62/466,603, filed Mar. 3, 2017; U.S. Provisional Application Ser. No. 62/484,047, filed Apr. 11, 2017, and U.S. Provisional Application Ser. No. 62/542,400, filed Aug. 8, 2017. The entire contents of the aforementioned applications are incorporated by reference herein in their entirety.

This application is a continuation application under 35 U.S.C. § 111(a) claiming the benefit of, and priority (under 35 U.S.C. § 120) to PCT Application No. PCT/US2018/020741, filed on Mar. 2, 2018, which claims priority to U.S. Provisional Application Ser. No. 62/466,601, filed Mar. 3, 2017; and U.S. Provisional Application Ser. No. 62/484,052, filed Apr. 11, 2017. The entire contents of the aforementioned applications are incorporated by reference herein in their entirety.

This application is a continuation application under 35 U.S.C. § 111(a) claiming the benefit of, and priority (under 35 U.S.C. § 120) to PCT Application No. PCT/US2018/020755, filed on Mar. 2, 2018, which claims priority to U.S. Provisional Application Ser. No. 62/466,601, filed Mar. 3, 2017; U.S. Provisional Application Ser. No. 62/484,062, filed Apr. 11, 2017, and U.S. Provisional Application Ser. No. 62/555,316, filed Sep. 7, 2017. The entire contents of the aforementioned applications are incorporated by reference herein in their entirety.

This application is a continuation application under 35 U.S.C. § 111(a) claiming the benefit of, and priority (under 35 U.S.C. § 120) to PCT Application No. PCT/US2018/020768, filed on Mar. 2, 2018, which claims priority to U.S. Provisional Application Ser. No. 62/466,601, filed Mar. 3, 2017; U.S. Provisional Application Ser. No. 62/484,060, filed Apr. 11, 2017, and U.S. Provisional Application Ser. No. 62/555,328, filed Sep. 7, 2017. The entire contents of the aforementioned applications are incorporated by reference herein in their entirety.

This application is a continuation application under 35 U.S.C. § 111(a) claiming the benefit of, and priority (under 35 U.S.C. § 120) to PCT Application No. PCT/US2018/020704, filed on Mar. 2, 2018, which claims priority to U.S. Provisional Application Ser. No. 62/466,601, filed Mar. 3, 2017; U.S. Provisional Application Ser. No. 62/484,063, filed Apr. 11, 2017, and U.S. Provisional Application Ser. No. 62/542,402, filed Aug. 8, 2017. The entire contents of the aforementioned applications are incorporated by reference herein in their entirety.

SEQUENCE LISTING

The present application is being filed along with a Sequence Listing in electronic format. The Sequence Listing is provided as a file entitled 2020-02-17-268052-454360_Final_SL.txt, created on Feb. 17, 2020, which is 12.6 MB. The information in the electronic format of the sequence listing is incorporated herein by reference in its entirety.

FIELD OF THE INVENTION

The present invention relates to regulatable tunable biocircuit systems for the development of controlled and/or regulated therapeutic systems, including polypeptides of biocircuit systems, effector modules, stimulus response elements (SREs) and immunotherapeutic agents, polynucleotides encoding the same, vectors and cells containing the polypeptides and/or polynucleotides for use in cancer immunotherapy. In one embodiment, the compositions comprise destabilizing domains (DDs) which tune protein stability. In particular, regulatable biocircuits containing destabilizing domains (DD) derived from human dihydrofolate reductase protein (hDHFR) are disclosed.

BACKGROUND OF THE INVENTION

Safe and effective gene therapy requires tightly regulated expression of a therapeutic transgenic product (e.g., the protein product). Similarly, the analysis of gene function in development, cell differentiation and other physiological activities requires the controllable expression of a protein under investigation. However, current technologies do not allow titration of the timing or levels of target protein induction. Inadequate exogenous and/or endogenous gene control is a critical issue in numerous gene therapy settings. This lack of tunability also makes it difficult to safely express proteins with narrow or uncertain therapeutic windows or those requiring more titrated or transient expression.

One approach to regulated protein expression or function is the use of Destabilizing Domains (DDs). Destabilizing domains are small protein domains that can be appended to a target protein of interest. DDs render the attached protein of interest unstable in the absence of a DD-binding ligand such that the protein is rapidly degraded by the ubiquitin-proteasome system of the cell (Stankunas, K., et al., (2003). *Mol. Cell* 12, 1615-1624; Banaszynski, L. A., et al., (2006) *Cell;* 126(5): 995-1004; reviewed in Banaszynski, L. A., and Wandless, T. J. (2006) *Chem. Biol.* 13, 11-21; Iwamoto, M., et al. (2010). *Chem Biol.* 17(9):981-8; Egeler, E. L. et al. (2011). *J Biol Chem.* 286(36):31328-36; and Rakhit R, Navarro R, Wandless T J (2014) *Chem Biol.* September 18; 21(9):1238-52; Navarro, R. et al. (2016)*ACS Chem Biol.* 11(8): 2101-2104). However, when a specific small molecule ligand binds its intended DD as a ligand binding partner, the instability is reversed and protein function is restored. Such a system is herein referred to as a biocircuit, with the canonical DD-containing biocircuit described above being the prototypical model biocircuit It is believed that improvements of biocircuits, including those containing DDs can form the basis of a new class of cell and gene therapies that employ tunable and temporal control of gene expression and function. Such novel moieties are described by the present inventors as stimulus response elements (SREs) which act in the context of an effector module to complete a biocircuit arising from a stimulus and ultimately producing a signal or outcome. When properly formatted with a polypeptide payload, and when activated by a particular stimulus, e.g., a small molecule, biocircuit systems can be used to regulate transgene and/or protein levels either up or down by perpetuating a stabilizing signal or destabilizing signal. This approach has many advantages over existing methods of regulating protein function and/or expression, which are currently focused on top level transcriptional regulation via inducible promoters.

The present invention provides novel protein domains, in particular destabilizing domains (DDs) derived from human dihydrofolate reductase (hDHFR) that display small molecule dependent stability, and the biocircuit systems and effector modules comprising such DDs. Methods for tuning transgene functions using the same are also provided.

Cancer immunotherapy aims to eradicate cancer cells by rejuvenating the tumoricidal functions of tumor-reactive immune cells, predominantly T cells. Strategies of cancer immunotherapy including the recent development of checkpoint blockade, adoptive cell transfer (ACT) and cancer vaccines which can increase the anti-tumor immune effector cells have produced remarkable results in several tumors.

The impact of host anti-tumor immunity and cancer immunotherapy is impeded by three major hurdles: 1) low number of tumor antigen-specific T cells due to clonal deletion; 2) poor activation of innate immune cells and accumulation of tolerogenic antigen-presenting cells in the tumor microenvironment; and 3) formation of an immunosuppressive tumor microenvironment. Particularly, in solid tumors the therapeutic efficacy of immunotherapeutic regimens remains unsatisfactory due to lack of an effective an anti-tumor response in the immunosuppressive tumor microenvironment. Tumor cells often induce immune tolerance or suppression and such tolerance is acquired because even truly foreign tumor antigens will become tolerated. Such tolerance is also active and dominant because cancer vaccines and adoptive transfer of pre-activated immune effector cells (e.g., T cells), are subject to suppression by inhibitory factors in the tumor microenvironment (TME).

In addition, administration of engineered T cells could result in on/off target toxicities as well as a cytokine release syndrome (reviewed by Tey Clin. Transl. Immunol., 2014, 3: e17 10.1038).

Development of a tunable switch that can turn on or off the transgenic immunotherapeutic agent expression is needed in case of adverse events. For example, adoptive cell therapies may have a very long and an indefinite half-life. Since toxicity can be progressive, a safety switch is desired to eliminate the infused cells. Systems and methods that can tune the transgenic protein level and expression window with high flexibility can enhance therapeutic benefit, and reduce potential side effects.

To develop regulatable therapeutic agents for disease therapy, in particular cancer immunotherapy, the present invention provides biocircuit systems to control the expression of immunotherapeutic agents. The biocircuit system comprises a stimulus and at least one effector module that responds to the stimulus. The effector module may include a stimulus response element (SRE) that binds and is responsive to a stimulus and an immunotherapeutic agent operably linked to the SRE. In one example, a SRE is a destabilizing domain (DD) which is destabilized in the absence of its specific ligand and can be stabilized by binding to its specific ligand.

SUMMARY OF THE INVENTION

The present invention provides novel protein domains displaying small molecule dependent stability. Such protein domains are called destabilizing domains (DDs). In the absence of its binding ligand, the DD is destabilizing and causes degradation of a payload fused to the DD (e.g., a protein of interest (POI), while in the presence of its binding ligand, the fused DD and payload can be stabilized, and its stability is dose dependent. These systems are further taught in co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety).

In some embodiments, the present invention provides biocircuit systems, effector modules and compositions comprising the DDs of the present invention. In one aspect, the biocircuit system is a DD biocircuit system.

The present invention provides biocircuit systems which may comprise an effector module. The effector module may comprise a stimulus response element (SRE) and at least one payload. In some embodiments, the payload of the effector module may comprise a protein of interest which is attached, appended or associated with the SRE. In some embodiments, the SRE comprises a destabilizing domain. The destabilizing domain may comprise in whole or in part, a protein such as, but not limited to human dihydrofolate reductase (hDHFR), a hDHFR mutant and a DHFR variant. In one aspect, the DD may comprise, in whole or in part, a hDHFR mutant.

In some embodiments, the effector module of the biocircuit may be responsive to one or more stimuli.

In one aspect, the DHFR mutant may comprise one, two or three mutations relative to SEQ ID NO. 3106). The DHFR mutant may have mutations such as, but not limited to, M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In some embodiments, the DHFR mutant may comprise one or more mutations in an amino acid at the mutation site being identical to one or more vicinal amino acids. The vicinal amino acid may be selected from, but not limited to one, two, three, four, and five amino acids, upstream or downstream from the mutation.

In some embodiments, the DHFR mutant may be selected from, but not limited to hDHFR (A107V), comprising the amino acid sequence of SEQ ID NO. 3107); hDHFR (F59S), comprising the amino acid sequence of SEQ ID NO. 3108); hDHFR (I17V), comprising the amino acid sequence of SEQ ID NO. 3109); hDHFR (K185E), comprising the amino acid sequence of SEQ ID NO. 3110); hDHFR (K81R), comprising the amino acid sequence of SEQ ID NO. 3111); hDHFR (M140I), comprising the amino acid sequence of SEQ ID NO. 3112); hDHFR (N127Y), comprising the amino acid sequence of SEQ ID NO. 3113); hDHFR (N186D), comprising the amino acid sequence of SEQ ID NO. 3114); hDHFR (N65D), comprising the amino acid sequence of SEQ ID NO. 3115); hDHFR (Y122I), comprising the amino acid sequence of SEQ ID NO. 3116); hDHFR (A10V, H88Y), comprising the amino acid sequence of SEQ ID NO. 3117); hDHFR (Amino acid 2-187 of WT) (Y122I), comprising the amino acid sequence of SEQ ID NO. 3118); hDHFR (C7R, Y163C), comprising the amino acid sequence of SEQ ID NO. 3119); hDHFR (E162G, I176F), comprising the amino acid sequence of SEQ ID NO. 3120); hDHFR (G21T, Y122I), comprising the amino acid sequence of SEQ ID NO. 3121); hDHFR (H131R, E144G), comprising the amino acid sequence of SEQ ID NO. 3122); hDHFR (I17V, Y122I), comprising the amino acid sequence of SEQ ID NO. 3123); hDHFR (L74N, Y122I), comprising the amino acid sequence of SEQ ID NO. 3124); hDHFR (L94A, T147A), comprising the amino acid sequence of SEQ ID NO. 3125); hDHFR (M53T, R138I), comprising the amino acid sequence of SEQ ID NO. 3126); hDHFR (N127Y, Y122I), comprising the amino acid sequence of SEQ ID NO. 3127); hDHFR (Q36K, Y122I), comprising the amino acid sequence of SEQ ID NO. 3128); hDHFR (T137R, F143L), comprising the amino acid sequence of SEQ ID NO. 3129); hDHFR (T57A, I72A), comprising the amino acid sequence of SEQ ID NO. 3130); hDHFR (V121A, Y122I), comprising the amino acid sequence of SEQ ID NO. 3131); hDHFR (V75F, Y122I), comprising the amino acid sequence of SEQ ID NO. 3132); hDHFR (Y122I, A125F), comprising the amino acid sequence of SEQ ID NO. 3133); hDHFR (Y122I, M140I), comprising the amino acid sequence of SEQ ID NO. 3134); hDHFR (Y178H, E181G), comprising the amino acid sequence of SEQ ID NO. 3135); hDHFR (Y183H, K185E), comprising the amino acid sequence of SEQ ID NO. 3136); hDHFR (Amino acid 2-187 of WT) (G21T, Y122I), comprising the amino acid sequence of SEQ ID NO. 3137); hDHFR (Amino acid 2-187 of WT) (I17V, Y122I), comprising the amino acid sequence of SEQ ID NO. 3138); hDHFR (Amino acid 2-187 of WT) (L74N, Y122I), comprising the amino acid sequence of SEQ ID NO. 3139); hDHFR (Amino acid 2-187 of WT) (L94A, T147A), comprising the amino acid sequence of SEQ ID NO. 3140); hDHFR (Amino acid 2-187 of WT) (M53T, R138I), comprising the amino acid sequence of SEQ ID NO. 3141); hDHFR (Amino acid 2-187 of WT) (N127Y, Y122I), comprising the amino acid sequence of SEQ ID NO. 3142); hDHFR (Amino acid 2-187 of WT) (Q36K, Y122I), comprising the amino acid sequence of SEQ ID NO. 3143); hDHFR (Amino acid 2-187 of WT) (V121A, Y122I), comprising the amino acid sequence of SEQ ID NO. 3144); hDHFR (Amino acid 2-187 of WT) (V75F, Y122I), comprising the amino acid sequence of SEQ ID NO. 3145); hDHFR (Amino acid 2-187 of WT) (Y122I, A125F), comprising the amino acid sequence of SEQ ID NO. 3146); hDHFR (Amino acid 2-187 of WT) (Y122I, M140I), comprising the amino acid sequence of SEQ ID NO. 3147); hDHFR (E31D, F32M, V116I), comprising the amino acid sequence of SEQ ID NO. 3148); hDHFR (G21E, I72V, I176T), comprising the amino acid sequence of SEQ ID NO. 3149); hDHFR (I8V, K133E, Y163C), comprising the amino acid sequence of SEQ ID NO. 3150); hDHFR (K19E, F89L, E181G), comprising the amino acid sequence of SEQ ID NO. 3151); hDHFR (L23S, V121A, Y157C), comprising the amino acid sequence of SEQ ID NO. 3152); hDHFR (N49D, F59S, D153G), comprising the amino acid sequence of SEQ ID NO. 3153); hDHFR (Q36F, N65F, Y122I), comprising the amino acid sequence of SEQ ID NO. 3154); hDHFR (Q36F, Y122I, A125F), comprising the amino acid sequence of SEQ ID NO. 3155); hDHFR (V110A, V136M, K177R), comprising the amino acid sequence of SEQ ID NO. 3156); hDHFR (V9A, S93R, P150L), comprising the amino acid sequence of SEQ ID NO. 3157); hDHFR (Y122I, H131R, E144G), comprising the amino acid sequence of SEQ ID NO. 3158); hDHFR (G54R, I115L, M140V, S168C), comprising the amino acid sequence of SEQ ID NO. 3159); hDHFR (Amino acid 2-187 of WT) (E31D, F32M, V116I), comprising the amino acid sequence of SEQ ID NO. 3160); hDHFR (Amino acid 2-187 of WT) (Q36F, N65F, Y122I), comprising the amino acid sequence of SEQ ID NO. 3161); hDHFR (Amino acid 2-187 of WT) (Q36F, Y122I, A125F), comprising the amino acid sequence of SEQ ID NO. 3162); hDHFR (Amino acid 2-187 of WT) (Y122I, H131R, E144G), comprising the amino acid sequence of SEQ ID NO. 3163); hDHFR (V2A, R33G, Q36R, L100P, K185R), comprising the amino acid sequence of SEQ ID NO. 3164); hDHFR (D22S, F32M, R33S, Q36S, N65S), comprising the amino acid sequence of SEQ ID NO. 3165); hDHFR (Amino acid 2-187 of WT) (D22S, F32M, R33S, Q36S, N65S), comprising the amino acid sequence of SEQ ID NO. 3166); hDHFR (I17N, L98S, K99R, M112T, E151G, E162G, E172G), comprising the amino acid sequence of SEQ ID NO. 3167); hDHFR (G16S, I17V, F89L, D96G, K123E, M140V, D146G, K156R), comprising the amino acid sequence of SEQ ID NO. 3168); hDHFR (K81R, K99R, L100P, E102G, N108D, K123R, H128R, D142G, F180L, K185E), comprising the amino acid sequence of SEQ ID NO. 3169); hDHFR (R138G, D142G, F143S, K156R, K158E, E162G, V166A, K177E, Y178C, K185E, N186S), comprising the amino acid sequence of SEQ ID NO. 3170); hDHFR (N14S, P24S, F35L, M53T, K56E, R92G, S93G, N127S, H128Y, F135L, F143S, L159P, L160P, E173A, F180L), comprising the amino acid sequence of SEQ ID NO. 3171); hDHFR (F35L, R37G, N65A, L68S, K69E, R71G, L80P, K99G, G117D, L132P, I139V, M140I, D142G, D146G, E173G, D187G), comprising the amino acid sequence of SEQ ID NO. 3172); hDHFR (L28P, N30H, M38V, V44A, L68S, N73G, R78G, A97T, K99R, A107T, K109R, D111N, L134P, F135V, T147A, I152V, K158R, E172G, V182A, E184R), comprising the amino acid sequence of SEQ ID NO. 3173); hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), comprising the amino acid sequence of SEQ ID NO. 3174); hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), comprising the amino acid sequence of SEQ ID NO. 3175); and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N), comprising the amino acid sequence of SEQ ID NO. 3176).

In one aspect, the hDHFR mutant may be encoded by a nucleic acid sequence independently selected from, but not limited to, SEQ ID NOs. 3177-3191), 3192), 3193), 3194), 3195-3229), 3230), 3231), 3232), 3233), 3234), 3235), 3236), 3237), 3238), 3239), 3240), 3241), 3242), 3243), 3244), or 3245).

In some embodiments, the stimulus of biocircuit system may be Trimethoprim or Methotrexate. In one aspect, the hDHFR mutant may comprise one or more mutations in a region that interacts directly with the stimulus.

In one aspect, the effector module may comprise a hDHFR-derived SRE operably linked to a payload. In some embodiments, the hDHFR-derived SRE may be a hDHFR mutant that may comprise one, two, three or more mutations selected from, but not limited to, M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In one aspect, the effector module may comprise a hDHFR-derived SRE selected from, but not limited to hDHFR (A107V), comprising the amino acid sequence of SEQ ID NO. 3246); hDHFR (F59S), comprising the amino acid sequence of SEQ ID NO. 3247); hDHFR (I17V), comprising the amino acid sequence of SEQ ID NO. 3248); hDHFR (K185E), comprising the amino acid sequence of SEQ ID NO. 3249); hDHFR (K81R), comprising the amino acid sequence of SEQ ID NO. 3250); hDHFR (M140I), comprising the amino acid sequence of SEQ ID NO. 3251); hDHFR (N127Y), comprising the amino acid sequence of SEQ ID NO. 3252); hDHFR (N186D), comprising the amino acid sequence of SEQ ID NO. 3253); hDHFR (N65D), comprising the amino acid sequence of SEQ ID NO. 3254); hDHFR (Y122I), comprising the amino acid sequence of SEQ ID NO. 3255); hDHFR (A10V, H88Y), comprising the amino acid sequence of SEQ ID NO. 3256); hDHFR (Amino acid 2-187 of WT) (Y122I), comprising the amino acid sequence of SEQ ID NO. 3257); hDHFR (C7R, Y163C), comprising the amino acid sequence of SEQ ID NO. 3258); hDHFR (E162G, I176F), comprising the amino acid sequence of SEQ ID NO. 3259); hDHFR (G21T, Y122I), comprising the amino acid sequence of SEQ ID NO. 3260); hDHFR (H131R, E144G), comprising the amino acid sequence of SEQ ID NO. 3261); hDHFR (I17V, Y122I), comprising the amino acid sequence of SEQ ID NO. 3262; hDHFR (L74N, Y122I), comprising the amino acid sequence of SEQ ID NO. 3263; hDHFR (L94A, T147A), comprising the amino acid sequence of SEQ ID NO. 3264; hDHFR (M53T, R138I), comprising the amino acid sequence of SEQ ID NO. 3265; hDHFR (N127Y, Y122I), comprising the amino acid sequence of SEQ ID NO. 3266; hDHFR (Q36K, Y122I), comprising the amino acid sequence of SEQ ID NO. 3267; hDHFR (T137R, F143L), comprising the amino acid sequence of SEQ ID NO. 3268; hDHFR (T57A, I72A), comprising the amino acid sequence of SEQ ID NO. 3269; hDHFR (V121A, Y122I), comprising the amino acid sequence of SEQ ID NO. 3270; hDHFR (V75F, Y122I), comprising the amino acid sequence of SEQ ID NO. 3271; hDHFR (Y122I, A125F), comprising the amino acid sequence of SEQ ID NO. 3272; hDHFR (Y122I, M140I), comprising the amino acid sequence of SEQ ID NO. 3273; hDHFR (Y178H, E181G), comprising the amino acid sequence of SEQ ID NO. 3274; hDHFR (Y183H, K185E), comprising the amino acid sequence of SEQ ID NO. 3275; hDHFR (Amino acid 2-187 of WT) (G21T, Y122I), comprising the amino acid sequence of SEQ ID NO. 3276; hDHFR (Amino acid 2-187 of WT) (I17V, Y122I), comprising the amino acid sequence of SEQ ID NO. 3277; hDHFR (Amino acid 2-187 of WT) (L74N, Y122I), comprising the amino acid sequence of SEQ ID NO. 3278; hDHFR (Amino acid 2-187 of WT) (L94A, T147A), comprising the amino acid sequence of SEQ ID NO. 3279; hDHFR (Amino acid 2-187 of WT) (M53T, R138I), comprising the amino acid sequence of SEQ ID NO. 3280; hDHFR (Amino acid 2-187 of WT) (N127Y, Y122I), comprising the amino acid sequence of SEQ ID NO. 3281; hDHFR (Amino acid 2-187 of WT) (Q36K, Y122I), comprising the amino acid sequence of SEQ ID NO. 3282; hDHFR (Amino acid 2-187 of WT) (V121A, Y122I), comprising the amino acid sequence of SEQ ID NO. 3283; hDHFR (Amino acid 2-187 of WT) (V75F, Y122I), comprising the amino acid sequence of SEQ ID NO. 3284; hDHFR (Amino acid 2-187 of WT) (Y122I, A125F), comprising the amino acid sequence of SEQ ID NO. 3285; hDHFR (Amino acid 2-187 of WT) (Y122I, M140I), comprising the amino acid sequence of SEQ ID NO. 3286; hDHFR (E31D, F32M, V116I), comprising the amino acid sequence of SEQ ID NO. 3287; hDHFR (G21E, I72V, I176T), comprising the amino acid sequence of SEQ ID NO. 3288; hDHFR (I8V, K133E, Y163C), comprising the amino acid sequence of SEQ ID NO. 3289; hDHFR (K19E, F89L, E181G), comprising the amino acid sequence of SEQ ID NO. 3290; hDHFR (L23S, V121A, Y157C), comprising the amino acid sequence of SEQ ID NO. 3291; hDHFR (N49D, F59S, D153G), comprising the amino acid sequence of SEQ ID NO. 3292; hDHFR (Q36F, N65F, Y122I), comprising the amino acid sequence of SEQ ID NO. 3293; hDHFR (Q36F, Y122I, A125F), comprising the amino acid sequence of SEQ ID NO. 3294; hDHFR (V110A, V136M, K177R), comprising the amino acid sequence of SEQ ID NO. 3295; hDHFR (V9A, S93R, P150L), comprising the amino acid sequence of SEQ ID NO. 3296; hDHFR (Y122I, H131R, E144G), comprising the amino acid sequence of SEQ ID NO. 3297; hDHFR (G54R, I115L, M140V, S168C), comprising the amino acid sequence of SEQ ID NO. 3298; hDHFR (Amino acid 2-187 of WT) (E31D, F32M, V116I), comprising the amino acid sequence of SEQ ID NO. 3299; hDHFR (Amino acid 2-187 of WT) (Q36F, N65F, Y122I), comprising the amino acid sequence of SEQ ID NO. 3300; hDHFR (Amino acid 2-187 of WT) (Q36F, Y122I, A125F), comprising the amino acid sequence of SEQ ID NO. 3301; hDHFR (Amino acid 2-187 of WT) (Y122I, H131R, E144G), comprising the amino acid sequence of SEQ ID NO. 3302; hDHFR (V2A, R33G, Q36R, L100P, K185R), comprising the amino acid sequence of SEQ ID NO. 3303; hDHFR (D22S, F32M, R33S, Q36S, N65S), comprising the amino acid sequence of SEQ ID NO. 3304; hDHFR (Amino acid 2-187 of WT) (D22S, F32M, R33S, Q36S, N65S), comprising the amino acid sequence of SEQ ID NO. 3305; hDHFR (I17N, L98S, K99R, M112T, E151G, E162G, E172G), comprising the amino acid sequence of SEQ ID NO. 3306; hDHFR (G16S, I17V, F89L, D96G, K123E, M140V, D146G, K156R), comprising the amino acid sequence of SEQ ID NO. 3307; hDHFR (K81R, K99R, L100P, E102G, N108D, K123R, H128R, D142G, F180L, K185E), comprising the amino acid sequence of SEQ ID NO. 3308; hDHFR (R138G, D142G, F143S, K156R, K158E, E162G, V166A, K177E, Y178C, K185E, N186S), comprising the amino acid sequence of SEQ ID NO. 3309; hDHFR (N14S, P24S, F35L, M53T, K56E, R92G, S93G, N127S, H128Y, F135L, F143S, L159P, L160P, E173A, F180L), comprising the amino acid sequence of SEQ ID NO. 3310; hDHFR (F35L, R37G, N65A, L68S, K69E, R71G, L80P, K99G, G117D, L132P, I139V, M140I, D142G, D146G, E173G, D187G), comprising the amino acid sequence of SEQ ID NO. 3311; hDHFR (L28P, N30H, M38V, V44A, L68S, N73G, R78G, A97T, K99R, A107T, K109R, D111N, L134P, F135V, T147A, I152V, K158R, E172G, V182A, E184R), comprising the amino acid sequence of SEQ ID NO. 3312; hDHFR (V2A, I17V, N30D, E31G, Q36R, F59S, K69E, I72T, H88Y, F89L, N108D, K109E, V110A, I115V, I115L, Y122D, L132P, F135S, M140V, E144G, T147A, Y157C, V170A, K174R, N186S), comprising the amino acid sequence of SEQ ID NO. 3313; hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), comprising the amino acid sequence of SEQ ID NO. 3314; and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N), comprising the amino acid sequence of SEQ ID NO. 3315.

In some embodiments, the payload of the effector module may be selected from, but not limited to, a natural protein, a variant thereof, a fusion polypeptide, an antibody or a fragment thereof, a therapeutic agent or a gene therapy agent.

In one aspect, the effector module may further comprise a protein cleavage site. As a non-limiting example, the protein cleavage site may be a furin cleavage site or a modified furin cleavage site.

In some embodiments, the hDHFR-derived SRE of the effector module may exhibit both a destabilization ratio between 0 and 0.09 and a destabilizing mutation co-efficient between 0.09. The destabilization ratio may comprise the ratio of expression, function or level of the payload in the absence of the stimulus specific to the hDHFR-derived SRE to the expression, function or level of the payload that is expressed constitutively in the absence of the same stimulus. The destabilizing mutation co-efficient may comprise the ratio of expression, function or level of the payload when operably linked to the hDHFR-derived SRE, in the absence of the stimulus specific to the hDHFR-derived SRE; to the expression, function or level of the payload when operably linked to the wildtype protein from which the hDHFR-derived SRE is derived and in the absence of the same stimulus. In one aspect, the hDHFR-derived SRE of the effector module may stabilize the payload by a stabilization ratio of 1 or more. The stabilization ratio may be the ratio of expression, function or level of the payload in the presence of the stimulus to the expression, function or level of the payload in the absence of the stimulus.

In one aspect, the payload of the effector module may be a protein of interest.

The present invention also provides vectors which may comprise a nucleic acid independently selected from, but not limited to any of the sequences selected from SEQ ID NOs. 3316-3318, 3319-3338, 3339-3342, 3343-3345 3346, 3347, 3348, 3349, 3350, 3351, 3352-3354, 3355-3358, 3359, or 3360-3365.

In some embodiments, the vector may be a viral vector. In some embodiments, the viral vector may be retroviral vector, a lentiviral vector, a rAAV vector, or an oncolytic viral vector.

The present invention also provides methods of tuning the expression level and/or activity of a protein of interest. The method of tuning described herein, may comprise appending or attaching a protein of interest to a hDHFR mutant. In some embodiments, the hDHFR mutant may comprise one, two, three or more mutations selected from M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In one embodiment, the DDs of the present invention may be stabilized by ligands such as Trimethoprim and Methotrexate.

In some embodiments, the effector module of the present invention is a fusion construct comprising a DD of the invention operably linked to a payload. In one aspect, the payload may be any natural protein of interest (POI) or variants thereof, an antibody or fragments thereof, a therapeutic agent, or any artificial peptide or polypeptide.

In some embodiments, the biocircuit system of the present invention comprising a stimulus and an effector module of the invention. The DD of the effector module binds to the stimulus and regulates the stability of the linked payload. The DD may destabilize the protein of interest by a destabilization ratio between 0, and 0.09, wherein the destabilization ratio comprises the ratio of expression, function or level of a protein of interest in the absence of the stimulus specific to the DD to the expression, function or level of the protein of interest that is expressed constitutively, and in the absence of the stimulus specific to the DD. In some embodiments, the DD may stabilize the protein of interest by a stabilization ratio of 1 or more, wherein the stabilization ratio comprises the ratio of expression, function or level of a protein of interest in the presence of the stimulus to the expression, function or level of the protein of interest in the absence of the stimulus.

In some embodiments, the biocircuit system of the present invention comprising a stimulus and an effector module of the invention. The DD of the effector module binds to the stimulus and regulates the stability of the linked payload.

In some embodiments, polynucleotides encoding destabilizing domains, effector modules and biocircuit systems, are provided. The polynucleotides of the invention may be codon optimized. Vectors comprising polynucleotides of the invention are also provided. In some aspects, the vector may be a non-viral vector, or a viral vector.

Methods for tuning the expression level and activity of a protein of interest using the DDs, effector modules, biocircuit systems and compositions of the invention are also provided.

The present invention provides compositions and methods for immunotherapy. The compositions relate to tunable systems and agents that induce anti-cancer immune responses in a cell or in a subject. The tunable system and agent may be a biocircuit system comprising at least one effector module that is responsive to at least one stimulus. The biocircuit system may be, but is not limited to, a destabilizing domain (DD) biocircuit system, a dimerization biocircuit system, a receptor biocircuit system, and a cell biocircuit system. These systems are further taught in co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety).

In some embodiments, the composition for inducing an immune response may comprise an effector module. In some embodiments, the effector module may comprise a stimulus response element (SRE) operably linked to at least one payload. In one aspect, the payload may be an immunotherapeutic agent.

In some embodiments, the immunotherapeutic agent may be selected from, but is not limited to a chimeric antigen receptor (CAR) and an antibody.

In one aspect, the SRE of the composition may be responsive to or interact with at least one stimulus.

In some embodiments, the SRE may comprise a destabilizing domain (DD). The DD may be derived from a parent protein or from a mutant protein having one, two, there, or more amino acid mutations compared to the parent protein. In some embodiments, the parent protein may be selected from, but is not limited to, human protein FKBP, comprising the amino acid sequence of SEQ ID NO. 3366; human DHFR (hDHFR), comprising the amino acid sequence of SEQ ID NO. 3367; E. Coli DHFR, comprising the amino acid sequence of SEQ ID NO. 3368; PDE5, comprising the amino acid sequence of SEQ ID NO. 3369; PPAR, gamma comprising the amino acid sequence of SEQ ID NO. 3370; CA2, comprising the amino acid sequence of SEQ ID NO. 3371; or NQO2, comprising the amino acid sequence of SEQ ID NO. 3372.

In one aspect, the parent protein is hDHFR and the DD comprises a mutant protein. The mutant protein may comprise a single mutation and may be selected from, but not limited to hDHFR (I17V), hDHFR (F59S), hDHFR (N65D), hDHFR (K81R), hDHFR (A107V), hDHFR (Y122I), hDHFR (N127Y), hDHFR (M140I), hDHFR (K185E), hDHFR (N186D), and hDHFR (M140I), hDHFR (Amino acid 2-187 of WT; N127Y), hDHFR (Amino acid 2-187 of WT; I17V), hDHFR (Amino acid 2-187 of WT; Y122I), and hDHFR (Amino acid 2-187 of WT; K185E). In some embodiments, the mutant protein may comprise two mutations and may be selected from, but not limited to, hDHFR (C7R, Y163C), hDHFR (A10V, H88Y), hDHFR (Q36K, Y122I), hDHFR (M53T, R138I), hDHFR (T57A, I72A), hDHFR (E63G, I176F), hDHFR (G21T, Y122I), hDHFR (L74N, Y122I), hDHFR (V75F, Y122I), hDHFR (L94A, T147A), DHFR (V121A, Y22I), hDHFR (Y122I, A125F), hDHFR (H131R, E144G), hDHFR (T137R, F143L), hDHFR (Y178H, E181G), and hDHFR (Y183H, K185E), hDHFR (E162G, I176F) hDHFR (Amino acid 2-187 of WT; I17V, Y122I), hDHFR (Amino acid 2-187 of WT; Y122I, M140I), hDHFR (Amino acid 2-187 of WT; N127Y, Y122I), hDHFR (Amino acid 2-187 of WT; E162G, I176F), and hDHFR (Amino acid 2-187 of WT; H131R, E144G), and hDHFR (Amino acid 2-187 of WT; Y122I, A125F). In some embodiments, the mutant may comprise three mutations and the mutant may be selected from hDHFR (V9A, S93R, P150L), hDHFR (I8V, K133E, Y163C), hDHFR (L23S, V121A, Y157C), hDHFR (K19E, F89L, E181G), hDHFR (Q36F, N65F, Y122I), hDHFR (G54R, M140V, S168C), hDHFR (V110A, V136M, K177R), hDHFR (Q36F, Y122I, A125F), hDHFR (N49D, F59S, D153G), and hDHFR (G21E, I72V, I176T), hDHFR (Amino acid 2-187 of WT; Q36F, Y122I, A125F), hDHFR (Amino acid 2-187 of WT; Y122I, H131R, E144G), hDHFR (Amino acid 2-187 of WT; E31D, F32M, V116I), and hDHFR (Amino acid 2-187 of WT; Q36F, N65F, Y122I). In some embodiments, the mutant may comprise four or more mutations and the mutant may be selected from hDHFR (V2A, R33G, Q36R, L100P, K185R), hDHFR (Amino acid 2-187 of WT; D22S, F32M, R33S, Q36S, N65S), hDHFR (I17N, L98S, K99R, M112T, E151G, E162G, E172G), hDHFR (G16S, I17V, F89L, D96G, K123E, M140V, D146G, K156R), hDHFR (K81R, K99R, L100P, E102G, N108D, K123R, H128R, D142G, F180L, K185E), hDHFR (R138G, D142G, F143S, K156R, K158E, E162G, V166A, K177E, Y178C, K185E, N186S), hDHFR (N14S, P24S, F35L, M53T, K56E, R92G, S93G, N127S, H128Y, F135L, F143S, L159P, L160P, E173A, F180L), hDHFR (F35L, R37G, N65A, L68S, K69E, R71G, L80P, K99G, G117D, L132P, I139V, M140I, D142G, D146G, E173G, D187G), hDHFR (L28P, N30H, M38V, V44A, L68S, N73G, R78G, A97T, K99R, A107T, K109R, D111N, L134P, F135V, T147A, I152V, K158R, E172G, V182A, E184R), hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184K, K185del, D187N).

In one aspect, the stimulus of the SRE may be Trimethoprim or Methotrexate.

In some embodiments, the immunotherapeutic agent of the effector module is a chimeric antigen receptor (CAR). The chimeric antigen may comprise an extracellular target moiety; a transmembrane domain; an intracellular signaling domain; and optionally, one or more co-stimulatory domains.

In one aspect, the CAR may be selected from, but is not limited to a standard CAR, a split CAR, an off-switch CAR, an on-switch CAR, a first-generation CAR, a second-generation CAR, a third-generation CAR, or a fourth-generation CAR.

In some embodiments, the extracellular target moiety of the CAR may be selected from, but is not limited to an Ig NAR, a Fab fragment, a Fab' fragment, a F(ab)'2 fragment, a F(ab)'3 fragment, an Fv, a single chain variable fragment (scFv), a bis-scFv, a (scFv)2, a minibody, a diabody, a triabody, a tetrabody, an intrabody, a disulfide stabilized Fv protein (dsFv), a unibody, a nanobody, and an antigen binding region derived from an antibody that may specifically bind to any of a protein of interest, a ligand, a receptor, a receptor fragment or a peptide aptamer.

In one aspect, the extracellular target moiety may be an scFv derived from an antibody. In one aspect, the scFv may specifically bind to a CD19 antigen In one aspect, the scFv of the CAR may be a CD19 scFv. In some embodiments, the CD19 scFv may comprise a heavy chain variable region having an amino acid sequence independently selected from the group consisting of SEQ ID NO: 3373-3404, and a light chain variable region having an amino acid sequence independently selected from the group consisting of any of SEQ ID NOs: 3405-3446. In some embodiments, the CD19 scFv may comprise an amino acid sequence selected from the group consisting of any of SEQ ID NOs: 3447-3591, and 3592.

In some embodiments, the intracellular signaling domain of the CAR may be a signaling domain derived from T cell receptor CD3zeta. In some embodiments, the intracellular signaling domain may be selected from a cell surface molecule selected from the group consisting of FcR gamma, FcR beta, CD3 gamma, CD3 delta, CD3 epsilon, CD5, CD22, CD79a, CD79b, and CD66d. In one aspect, the CAR may include a co-stimulatory domain. In some embodiments, the co-stimulatory domain may be selected from the group consisting of 2B4, HVEM, ICOS, LAG3, DAP10, DAP12, CD27, CD28, 4-1BB (CD137), OX40 (CD134), CD30, CD40, ICOS (CD278), glucocorticoid-induced tumor necrosis factor receptor (GITR), lymphocyte function-associated antigen-1 (LFA-1), CD2, CD7, LIGHT, NKG2C, and B7-H3.

(b) the co-stimulatory domain is present and is selected from the group consisting of 2B4, HVEM, ICOS, LAG3, DAP10, DAP12, CD27, CD28, 4-1BB (CD137), OX40 (CD134), CD30, CD40, ICOS (CD278), glucocorticoid-induced tumor necrosis factor receptor (GITR), lymphocyte function-associated antigen-1 (LFA-1), CD2, CD7, LIGHT, NKG2C, and B7-H3.

In some embodiments, the intracellular signaling domain of the CAR may be a T cell receptor CD3zeta signaling domain, which may comprise the amino acid sequence of SEQ ID NO: 3593.

In some embodiments, T cell receptor CD3zeta signaling domain of the CAR, comprising the amino acid sequence of SEQ ID NO: 3594, may further comprise at least one co-stimulatory domain. The co-stimulatory domain may comprise an amino acid sequence of SEQ ID NOs: 421-422, 424-527 and 2739.

In one embodiment, the transmembrane domain of the CAR may be derived from a transmembrane region of an alpha, beta or zeta chain of a T-cell receptor. In one aspect, the transmembrane domain may be derived from the CD3 epsilon chain of a T-cell receptor. In one embodiment, the transmembrane domain may be derived from a molecule selected from CD4, CD5, CD8, CD8a, CD9, CD16, CD22, CD33, CD28, CD37, CD45, CD64, CD80, CD86, CD148, DAP 10, EpoRI, GITR, LAG3, ICOS, Her2, OX40 (CD134), 4-1BB (CD137), CD152, CD154, PD-1, or CTLA-4. In another embodiment, the transmembrane domain may be derived from an immunoglobulin selected from IgG1, IgD, IgG4, and an IgG4 Fc region. In one aspect, the transmembrane domain may comprise an amino acid sequence selected from the group consisting of any of SEQ ID NOs: 3595-3645, and 3646-3656.

In some embodiments, the CAR of the effector module may further comprise a hinge region near the transmembrane domain. In one aspect, the hinge region may comprise an amino acid sequence selected from the group consisting of any of SEQ ID NOs: 590-633, 635-668 and 2741.

In some embodiments, the immunotherapeutic agent may be an antibody that is specifically immunoreactive to an antigen selected from a tumor specific antigen (TSA), a tumor associated antigen (TAA), or an antigenic epitope.

In one aspect, the antigen may be an antigenic epitope. In some embodiments, the antigenic epitope may be CD19.

In some embodiments, the antibody may comprise a heavy chain variable region having an amino acid sequence independently selected from the group consisting of any of SEQ ID NOs: 3657-3688 and a light chain variable region having an amino acid sequence independently selected from the group consisting of any of SEQ ID NOs: 3689-3730. In one aspect, the antibody may comprise an amino acid sequence selected from the group consisting of any of SEQ ID NOs: 3731-3875, and 3876.

In one aspect, the first effector module may comprise the amino acid sequence of any of SEQ ID NO: 38773891, 3892-3897, 3898-3901, and 3902-3918.

In some embodiments, the first SRE of the effector module may stabilize the immunotherapeutic agent by a stabilization ratio of 1 or more, wherein the stabilization ratio may comprise the ratio of expression, function or level of the immunotherapeutic agent in the presence of the stimulus to the expression, function or level of the immunotherapeutic agent in the absence of the stimulus.

In some embodiments, the SRE may destabilize the immunotherapeutic agent by a destabilization ratio between 0, and 0.09, wherein the destabilization ratio may comprise the ratio of expression, function or level of the immunotherapeutic agent in the absence of the stimulus specific to the SRE to the expression, function or level of the immunotherapeutic agent that is expressed constitutively, and in the absence of the stimulus specific to the SRE.

The present invention also provides polynucleotides comprising the compositions of the invention.

In one aspect, the polynucleotides may be a DNA or RNA molecule. In one aspect, the polynucleotides may comprise spatiotemporally selected codons. In one aspect, the polynucleotides of the invention may be a DNA molecule. In some embodiments, the polynucleotides may be an RNA molecule. In one aspect, the RNA molecule may be a messenger molecule. In some embodiments, the RNA molecule may be chemically modified.

In some embodiments, the polynucleotides may further comprise, at least one additional feature selected from, but not limited to, a promoter, a linker, a signal peptide, a tag, a cleavage site and a targeting peptide.

The present invention also provides vectors comprising polynucleotides described herein. In one aspect, the vector may be a viral vector. In some embodiments, the viral vector may be a retroviral vector, a lentiviral vector, a gamma retroviral vector, a recombinant AAV vector, an adeno viral vector, and an oncolytic viral vector.

The present invention also provides immune cells for adoptive cell transfer (ACT) which may express the compositions of the invention, the polynucleotides described herein. In one aspect, the immune cells may be infected or transfected with the vectors described herein. The immune cells for ACT may be selected from, but not limited to a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK)

cell, a dendritic cell, a human embryonic stem cell, a mesenchymal stem cell, a hematopoietic stem cell, or a mixture thereof.

In some embodiments, the immune cells may be autologous, allogeneic, syngeneic, or xenogeneic in relation to a particular individual subject.

In some embodiments, the immune cell may further express a composition comprising a second effector module, said second effector module comprising a second SRE linked to a second immunotherapeutic agent. In one aspect, the second immunotherapeutic agent may be selected from a cytokine, and a cytokine-cytokine receptor fusion.

In one aspect, the second immunotherapeutic agent may be a cytokine. In one aspect, the cytokine may be IL12 or IL15.

In one aspect, the second immunotherapeutic agent may be a cytokine-cytokine receptor fusion polypeptide.

In some embodiments, the cytokine-cytokine receptor fusion polypeptide may be selected from, but is not limited to a IL12-IL12 receptor fusion polypeptide, a IL15-IL15 receptor fusion polypeptide, and a IL15-IL15 receptor sushi domain fusion polypeptide.

The present invention provides methods for reducing a tumor volume or burden in a subject comprising contacting the subject with the immune cells of the invention. Also provided herein, is a method for inducing an anti-tumor immune response in a subject, comprising administering the immune cells of the system to the subject.

The present invention also provides methods for enhancing the expansion and/or survival of immune cells, comprising contacting the immune cells with the compositions of the invention, the polynucleotides of the invention, and/or the vectors of the invention.

Also provided herein, is a method for inducing an immune response in a subject, administering the compositions of the invention, the polynucleotides of the invention, and/or the immune cells of the invention to the subject.

The present invention also provides a method of identifying a domain of a CD19 antigen which will not bind the FMC63 antibody (FMC63-distinct CD19 binding domain). The method may comprise (a) preparing a composition comprising a CD19 antigen, (b) contacting the composition in (a) with saturating levels of FMC63 antibody, (c) contacting the composition of step (b) with one or more selected members of a library of potential CD19 binders; and (d) identifying a binding domain on the CD19 antigen based on the differential binding of the selected members of the library of CD19 binders compared to the binding of FMC63. In some embodiments, the binding domains of the library may be generated using phage display techniques with the CD19 antigen as the seed sequence. In one aspect, the binding domain may be selected from a Fab fragment, a Fab' fragment, a F(ab)'2 fragment, a F(ab)'3 fragment, Fv, a single chain variable fragment (scFv), a bis-scFv, a (scFv)2, a minibody, a diabody, a triabody, a tetrabody, a disulfide stabilized Fv protein (dsFv), a unibody, a nanobody, or an antigen binding region of an antibody, and an antibody fragment. In one aspect, the CD19 antigen may be selected from a whole or a portion of a human CD19 antigen, and a whole or a portion of a Rhesus CD19 antigen.

The present invention also provides chimeric antigen receptors that may comprise the FMC63-distinct CD19 binding domain obtained according to the methods described herein. Also, provided herein is a stimulus response element (SRE) operably linked to the chimeric antigen receptors that include the FMC63-distinct CD19 binding domain.

In some embodiments, the effector module comprises a stimulus response element (SRE) and at least one payload comprising a protein of interest (POI).

In some embodiments, the SRE may be a destabilizing domain (DD). In some examples, the DD is a mutant domain derived from a protein such as FKBP (FK506 binding protein), E. coli DHFR (Dihydrofolate reductase) (ecDHFR), human DHFR (hDHFR), or any protein of interest. In this context, the biocircuit system is a DD biocircuit system.

The payload may be any immunotherapeutic agent used for cancer immunotherapy such as a chimeric agent receptor (CAR) such as CD19 CAR that targets any molecule of tumor cells, an antibody, an antigen binding domain or combination of antigen binding domains, a cytokine such as IL12, IL15 or IL15/IL15Ra fusion, or any agent that can induce an immune response. The SRE and payload may be operably linked through one or more linkers and the positions of components may vary within the effector module.

In some embodiments, the effector module may further comprise of one or more additional features such as linker sequences (with specific sequences and lengths), cleavage sites, regulatory elements (that regulate expression of the protein of interest such as microRNA targeting sites), signal sequences that lead the effector module to a specific cellular or subcellular location, penetrating sequences, or tags and biomarkers for tracking the effector module.

In some embodiments, the DD may stabilize the immunotherapeutic agent with a stabilization ratio of at least one in the presence of the stimulus. According to the present invention, the DD may destabilize the immunotherapeutic agent in the absence of ligand with a destabilization ratio between 0, and 0.99.

The invention provides isolated biocircuit polypeptides, effector modules, stimulus response elements (SREs) and payloads, as well as polynucleotides encoding any of the foregoing; vectors comprising polynucleotides of the invention; and cells expressing polypeptides, polynucleotides and vectors of the invention. The polypeptides, polynucleotides, viral vectors and cells are useful for inducing anti-tumor immune responses in a subject.

In some embodiments, the vector of the invention is a viral vector. The viral vector may include, but is not limited to a retroviral vector, an adenoviral vector, an adeno-associated viral vector, or a lentiviral vector.

In some embodiments, the vector of the invention may be a non-viral vector, such as a nanoparticles and liposomes.

The present invention also provides immune cells engineered to include one or more polypeptides, polynucleotides, or vectors of the present invention. The cells may be immune effector cells, including T cells such as cytotoxic T cells, helper T cells, memory T cells, regulatory T cells, natural killer (NK) cells, NK T cells, cytokine-induced killer (CIK) cells, cytotoxic T lymphocytes (CTLs), and tumor infiltrating lymphocytes (TILs). The engineered cell may be used for adoptive cell transfer for treating a disease (e.g., a cancer).

The present invention also provides methods for inducing immune responses in a subject using the compositions of the invention. Also provided are methods for reducing a tumor burden in a subject using the compositions of the invention.

Also provided herein are methods for identifying FMC63-distinct binding domains and using CD19 antigens in which the FMC63 binding epitope is masked or absent. In some embodiments, the FMC63 binding domain may be included in the payloads and effector modules of the invention.

The present invention provides compositions and methods for immunotherapy. The compositions relate to tunable systems and agents that induce an immune response in a cell or in a subject. The tunable system and agent may be a biocircuit system comprising at least one effector module that is responsive to at least one stimulus. The biocircuit system may be, but is not limited to, a destabilizing domain (DD) biocircuit system, a dimerization biocircuit system, a receptor biocircuit system, and a cell biocircuit system. These systems are further taught in co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety).

In some embodiments, the composition for inducing an immune response may comprise an effector module. In some embodiments, the effector module may comprise a stimulus response element (SRE) operably linked to at least one payload. In one aspect, the payload may be an immunotherapeutic agent.

In some embodiments, the immunotherapeutic agent may be selected from, but not limited to a cytokine, a cytokine receptor, a cytokine-cytokine receptor fusion, and any combinations thereof.

In one aspect, the SRE of the composition may be responsive to or interact with at least one stimulus.

In some embodiments, the SRE may comprise a destabilizing domain (DD). The DD may be derived from a parent protein or from a mutant protein having one, two, there, or more amino acid mutations compared to the parent protein. In some embodiments, the parent protein may be selected from, but is not limited to, human protein FKBP, comprising the amino acid sequence of SEQ. ID NO. 3919; human DHFR (hDHFR), comprising the amino acid sequence of SEQ. ID NO. 3920; E. Coli DHFR, comprising the amino acid sequence of SEQ. ID NO. 3921; PDE5, comprising the amino acid sequence of SEQ. ID NO. 3922; PPAR, gamma comprising the amino acid sequence of SEQ ID NO. 3923; CA2, comprising the amino acid sequence of SEQ. ID NO. 3924; or NQO2, comprising the amino acid sequence of SEQ. ID NO. 3925.

In one aspect, the parent protein is hDHFR and the DD comprises a mutant protein. The mutant protein may comprise a single mutation and may be selected from, but not limited to hDHFR (I17V), hDHFR (F59S), hDHFR (N65D), hDHFR (K81R), hDHFR (A107V), hDHFR (Y122I), hDHFR (N127Y), hDHFR (M140I), hDHFR (K185E), hDHFR (N186D), and hDHFR (M140I), hDHFR (Amino acid 2-187 of WT; N127Y), hDHFR (Amino acid 2-187 of WT; I17V), hDHFR (Amino acid 2-187 of WT; Y122I), and hDHFR (Amino acid 2-187 of WT; K185E). In some embodiments, the mutant protein may comprise two mutations and may be selected from, but not limited to, hDHFR (C7R, Y163C), hDHFR (A10V, H88Y), hDHFR (Q36K, Y122I), hDHFR (M53R, R138I), hDHFR (T57A, I72A), hDHFR (E63G, I176F), hDHFR (G21T, Y122I), hDHFR (L74N, Y122I), hDHFR (V75F, Y122I), hDHFR (L94A, T147A), DHFR (V121A, Y22I), hDHFR (Y122I, A125F), hDHFR (H131R, E144G), hDHFR (T137R, F143L), hDHFR (Y178H, E181G), and hDHFR (Y183H, K185E) hDHFR (E162G, I176F) hDHFR (Amino acid 2-187 of WT; I17V, Y122I), hDHFR (Amino acid 2-187 of WT; Y122I, M140I), hDHFR (Amino acid 2-187 of WT; N127Y, Y122I), hDHFR (Amino acid 2-187 of WT; E162G, I176F), hDHFR (Amino acid 2-187 of WT; H131R, E144G), and hDHFR (Amino acid 2-187 of WT; Y122I, A125F). In some embodiments, the mutant may comprise three mutations and the mutant may be selected from hDHFR (V9A, S93R, P150L), hDHFR (I8V, K133E, Y163C), hDHFR (L23S, V121A, Y157C), hDHFR (K19E, F89L, E181G), hDHFR (Q36F, N65F, Y122I), hDHFR (G54R, M140V, S168C), hDHFR (V110A, V136M, K177R), hDHFR (Q36F, Y122I, A125F), hDHFR (N49D, F59S, D153G), and hDHFR (G21E, I72V, I176T), hDHFR (Amino acid 2-187 of WT; Q36F, Y122I, A125F), hDHFR (Amino acid 2-187 of WT; Y122I, H131R, E144G), hDHFR (Amino acid 2-187 of WT; E31D, F32M, V116I), and hDHFR (Amino acid 2-187 of WT; Q36F, N65F, Y122I). In some embodiments, the mutant may comprise four or more mutations and the mutant may be selected from hDHFR (V2A, R33G, Q36R, L100P, K185R), hDHFR (Amino acid 2-187 of WT; D22S, F32M, R33S, Q36S, N65S), hDHFR (I17N, L98S, K99R, M112T, E151G, E162G, E172G), hDHFR (G16S, I17V, F89L, D96G, K123E, M140V, D146G, K156R), hDHFR (K81R, K99R, L100P, E102G, N108D, K123R, H128R, D142G, F180L, K185E), hDHFR (R138G, D142G, F143S, K156R, K158E, E162G, V166A, K177E, Y178C, K185E, N186S), hDHFR (N14S, P24S, F35L, M53T, K56E, R92G, S93G, N127S, H128Y, F135L, F143S, L159P, L160P, E173A, F180L), hDHFR (F35L, R37G, N65A, L68S, K69E, R71G, L80P, K99G, G117D, L132P, I139V, M140I, D142G, D146G, E173G, D187G), hDHFR (L28P, N30H, M38V, V44A, L68S, N73G, R78G, A97T, K99R, A107T, K109R, D111N, L134P, F135V, T147A, I152V, K158R, E172G, V182A, E184R), hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N).

In one aspect, the stimulus of the SRE may be Trimethoprim or Methotrexate.

In some embodiments, the immunotherapeutic agent of the composition may be a cytokine. The cytokine may be an interleukin, an interferon, a tumor necrosis factor, a transforming growth factor B, a CC chemokine, a CXC chemokine, a CX3C chemokine or a growth factor.

In one aspect, the interleukin may be a whole or a portion of a IL15 and may comprise the amino acid sequence of SEQ ID NO. 3926. In one aspect, the IL15 may be modified. In some embodiments, the modifications may comprise fusing SEQ ID NO. 3926 to the whole or a portion of, a transmembrane domain. The IL15 may optionally be modified by incorporating a hinge domain.

In one aspect, the immunotherapeutic agent may be a cytokine-cytokine receptor fusion polypeptide. In some embodiments, the cytokine-cytokine receptor fusion polypeptide may comprise the whole or a portion of SEQ. ID NO. 3926, fused to the whole or a portion of any of SEQ. ID NOs. 3927-3934 to produce a IL15-IL15 receptor fusion polypeptide.

In some embodiments, the cytokine-cytokine receptor fusion polypeptide may be modified. The modification may comprise fusing the IL15-IL15 receptor fusion polypeptide to the whole, or a portion, of a transmembrane protein. In one aspect, an optional hinge domain may be incorporated.

In one aspect, the SRE of the composition may stabilize the immunotherapeutic agent by a stabilization ratio of 1 or more. The stabilization ratio may comprise the ratio of expression, function or level of the immunotherapeutic agent in the presence of the stimulus to the expression, function or level of the immunotherapeutic agent in the absence of the stimulus.

In one aspect, the SRE of the composition may destabilize the immunotherapeutic agent by a destabilization ratio between 0, and 0.09. The destabilization ratio may comprise the ratio of expression, function or level of an immunotherapeutic agent in the absence of the stimulus specific to the SRE to the expression, function or level of the immunotherapeutic agent that is expressed constitutively, and in the absence of the stimulus specific to the SRE.

The present invention also provides polynucleotides comprising the compositions of the invention.

In one aspect, the polynucleotides may be a DNA or RNA molecule. In one aspect, the polynucleotides may comprise spatiotemporally selected codons. In one aspect, the polynucleotides of the invention may be a DNA molecule. In some embodiments, the polynucleotides may be an RNA molecule. In one aspect, the RNA molecule may be a messenger molecule. In some embodiments, the RNA molecule may be chemically modified.

In some embodiments, the polynucleotides may further comprise, at least one additional feature selected from, but not limited to, a promoter, a linker, a signal peptide, a tag, a cleavage site and a targeting peptide.

The present invention also provides vectors comprising polynucleotides described herein. In one aspect, the vector may be a viral vector. In some embodiments, the viral vector may be a retroviral vector, a lentiviral vector, a gamma retroviral vector, a recombinant AAV vector, an adeno viral vector, and an oncolytic viral vector.

The present invention also provides immune cells for adoptive cell transfer (ACT) which may express the compositions of the invention, the polynucleotides described herein. In one aspect, the immune cells may be infected or transfected with the vectors described herein. The immune cells for ACT may be selected from, but not limited to a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

In some embodiments, the immune cells may be autologous, allogeneic, syngeneic, or xenogeneic in relation to a particular individual subject.

The present invention provides methods for reducing a tumor volume or burden in a subject comprising contacting the subject with the immune cells of the invention. Also provided herein, is a method for inducing an anti-tumor immune response in a subject, comprising administering the immune cells of the system to the subject.

The present invention also provides methods for enhancing the expansion and/or survival of immune cells, comprising contacting the immune cells with the compositions of the invention, the polynucleotides of the invention, and/or the vectors of the invention.

Also provided herein, is a method for inducing an immune response in a subject, administering the compositions of the invention, the polynucleotides of the invention, and/or the immune cells of the invention to the subject.

In some embodiments, the effector module comprises a stimulus response element (SRE) and at least one payload comprising a payload of interest (POI).

In some embodiments, the SRE may be a destabilizing domain (DD). In some examples, the DD is a domain derived from a protein such as FKBP (FK506 binding protein), E. coli DHFR (Dihydrofolate reductase) (ecDHFR), human DHFR (hDHFR), or any payload of interest. In this context, the biocircuit system is a DD biocircuit system.

The payload may be an immunotherapeutic agent used for cancer immunotherapy such as a cytokine such as IL15 or a cytokine-cytokine receptor polypeptides such as IL15/IL15Ra fusion polypeptide, or any agent that can induce an immune response. The SRE and payload may be operably linked through one or more linkers and the positions of components may vary within the effector module.

In some embodiments, the effector module may further comprise one or more additional features such as linker sequences (with specific sequences and lengths), cleavage sites, regulatory elements (that regulate expression of the protein of interest such as microRNA targeting sites), signal sequences that lead the effector module to a specific cellular or subcellular location, penetrating sequences, or tags and biomarkers for tracking the effector module.

In some embodiments, the DD may stabilize the protein of interest with a stabilization ratio of at least one in the presence of the stimulus. According to the present invention, the DD may destabilize the protein of interest in the absence of ligand with a destabilization ratio between 0, and 0.99.

The present invention also provides immunotherapeutic agents which may be a cytokine fused to its cognate cytokine receptor. In one embodiment, the immotherapeutic agent of the invention may a fusion polypeptide comprising the whole or a portion of IL15 fused to the whole or a portion of the IL15Ra. Such fusion polypeptides may be membrane associated or secreted.

The invention provides isolated biocircuit polypeptides, effector modules, stimulus response elements (SREs) and payloads, as well as polynucleotides encoding any of the foregoing; vectors comprising polynucleotides of the invention; and cells expressing polypeptides, polynucleotides and vectors of the invention. The polypeptides, polynucleotides, viral vectors and cells are useful for inducing anti-tumor immune responses in a subject.

In some embodiments, the vector of the invention is a viral vector. The viral vector may include, but is not limited to a retroviral vector, an adenoviral vector, an adeno-associated viral vector, or a lentiviral vector.

In some embodiments, the vector of the invention may be a non-viral vector, such as a nanoparticles and liposomes.

The present invention also provides immune cells engineered to include one or more polypeptides, polynucleotides, or vectors of the present invention. The cells may be immune effector cells, including T cells such as cytotoxic T cells, helper T cells, memory T cells, regulatory T cells, natural killer (NK) cells, NK T cells, cytokine-induced killer (CIK) cells, cytotoxic T lymphocytes (CTLs), and tumor infiltrating lymphocytes (TILs). The engineered cell may be used for adoptive cell transfer for treating a disease (e.g., a cancer). Methods of enhancing the expansion and/or survival of immune cells are also disclosed herein.

The present invention also provides methods for inducing immune responses in a subject using the compositions of the invention. Also provided are methods for reducing a tumor burden in a subject using the compositions of the invention.

Provided herein are methods for tuning the expression and function of immunotherapeutic agent in cells or subjects. Such method may involve the administering effector modules containing an SRE operably linked to an immunotherapeutic agent. In some embodiments, the immunotherapeutic agent is IL15 or IL15 fused to IL15Ra. In some embodiments, the SRE is derived from FKBP, DHFR, PDE5, PPAR gamma, CA2 and NQO2.

The present invention provides compositions and methods for immunotherapy. The compositions relate to tunable systems and agents that induce anti-cancer immune responses in a cell or in a subject. The tunable system and agent may be a biocircuit system comprising at least one effector module that is responsive to at least one stimulus. The biocircuit system may be, but is not limited to, a destabilizing domain (DD) biocircuit system, a dimerization biocircuit system, a receptor biocircuit system, and a cell biocircuit system. These systems are further taught in co-owned U.S. Provisional Patent Application No. 62/320,864 filed Apr. 11, 2016, 62/466,596 filed Mar. 3, 2017 and the International Publication WO2017/180587 (the contents of each of which are herein incorporated by reference in their entirety).

In some embodiments, the composition for inducing an immune response may comprise an effector module. In some embodiments, the effector module may comprise a stimulus response element (SRE) operably linked to at least one payload. In one aspect, the payload may be an immunotherapeutic agent.

In some embodiments, the immunotherapeutic agent may be selected from, but not limited to a cytokine, a cytokine receptor, a cytokine-cytokine receptor fusion, and any combinations thereof.

In one aspect, the SRE of the composition may be responsive to or interact with at least one stimulus.

In some embodiments, the SRE may comprise a destabilizing domain (DD). The DD may be derived from a parent protein or from a mutant protein having one, two, there, or more amino acid mutations compared to the parent protein. In some embodiments, the parent protein may be selected from, but is not limited to, human protein FKBP, comprising the amino acid sequence of SEQ ID NO. 3935; human DHFR (hDHFR), comprising the amino acid sequence of SEQ ID NO. 3936; E. Coli DHFR, comprising the amino acid sequence of SEQ ID NO. 3937; PDE5, comprising the amino acid sequence of SEQ ID NO. 3938; PPAR, gamma comprising the amino acid sequence of SEQ ID NO. 3939; CA2, comprising the amino acid sequence of SEQ ID NO. 3940; or NQO2, comprising the amino acid sequence of SEQ ID NO. 3941.

In one aspect, the parent protein is hDHFR and the DD comprises a mutant protein. The mutant protein may comprise a single mutation and may be selected from, but not limited to hDHFR (I17V), hDHFR (F59S), hDHFR (N65D), hDHFR (K81R), hDHFR (A107V), hDHFR (Y122I), hDHFR (N127Y), hDHFR (M140I), hDHFR (K185E), hDHFR (N186D), and hDHFR (M140I), hDHFR (Amino acid 2-187 of WT; N127Y), hDHFR (Amino acid 2-187 of WT; I17V), hDHFR (Amino acid 2-187 of WT; Y122I), and hDHFR (Amino acid 2-187 of WT; K185E). In some embodiments, the mutant protein may comprise two mutations and may be selected from, but not limited to, hDHFR (C7R, Y163C), hDHFR (A10V, H88Y), hDHFR (Q36K, Y122I), hDHFR (M53T, R138I), hDHFR (T57A, I72A), hDHFR (E63G, I176F), hDHFR (G21T, Y122I), hDHFR (L74N, Y122I), hDHFR (V75F, Y122I), hDHFR (L94A, T147A), DHFR (V121A, Y22I), hDHFR (Y122I, A125F), hDHFR (H131R, E144G), hDHFR (T137R, F143L), hDHFR (Y178H, E181G), and hDHFR (Y183H, K185E), hDHFR (E162G, I176F) hDHFR (Amino acid 2-187 of WT; I17V, Y122I), hDHFR (Amino acid 2-187 of WT; Y122I, M140I), hDHFR (Amino acid 2-187 of WT; N127Y, Y122I), hDHFR (Amino acid 2-187 of WT; E162G, I176F), and hDHFR (Amino acid 2-187 of WT; H131R, E144G), and hDHFR (Amino acid 2-187 of WT; Y122I, A125F). In some embodiments, the mutant may comprise three mutations and the mutant may be selected from hDHFR (V9A, S93R, P150L), hDHFR (I8V, K133E, Y163C), hDHFR (L23S, V121A, Y157C), hDHFR (K19E, F89L, E181G), hDHFR (Q36F, N65F, Y122I), hDHFR (G54R, M140V, S168C), hDHFR (V110A, V136M, K177R), hDHFR (Q36F, Y122I, A125F), hDHFR (N49D, F59S, D153G), and hDHFR (G21E, I72V, I176T), hDHFR (Amino acid 2-187 of WT; Q36F, Y122I, A125F), hDHFR (Amino acid 2-187 of WT; Y122I, H131R, E144G), hDHFR (Amino acid 2-187 of WT; E31D, F32M, V116I), and hDHFR (Amino acid 2-187 of WT; Q36F, N65F, Y122I). In some embodiments, the mutant may comprise four or more mutations and the mutant may be selected from hDHFR (V2A, R33G, Q36R, L100P, K185R), hDHFR (Amino acid 2-187 of WT; D22S, F32M, R33S, Q36S, N65S), hDHFR (I17N, L98S, K99R, M112T, E151G, E162G, E172G), hDHFR (G16S, I17V, F89L, D96G, K123E, M140V, D146G, K156R), hDHFR (K81R, K99R, L100P, E102G, N108D, K123R, H128R, D142G, F180L, K185E), hDHFR (R138G, D142G, F143S, K156R, K158E, E162G, V166A, K177E, Y178C, K185E, N186S), hDHFR (N14S, P24S, F35L, M53T, K56E, R92G, S93G, N127S, H128Y, F135L, F143S, L159P, L160P, E173A, F180L), hDHFR (F35L, R37G, N65A, L68S, K69E, R71G, L80P, K99G, G117D, L132P, I139V, M140I, D142G, D146G, E173G, D187G), hDHFR (L28P, N30H, M38V, V44A, L68S, N73G, R78G, A97T, K99R, A107T, K109R, D111N, L134P, F135V, T147A, I152V, K158R, E172G, V182A, E184R), hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N).

In one aspect, the stimulus of the SRE may be Trimethoprim or Methotrexate.

In some embodiments, the immunotherapeutic agent of the composition may be a cytokine. The cytokine may be an interleukin, an interferon, a tumor necrosis factor, a transforming growth factor B, a CC chemokine, a CXC chemokine, a CX3C chemokine or a growth factor.

In one aspect, the interleukin may be a whole or a portion of a IL12 and may comprise a p40 subunit (the amino acid sequence of SEQ ID NO. 3942) or portion thereof and/or a p35 subunit (the amino acid sequence of SEQ ID NO. 3943). In one aspect, the IL12 may be modified. In some embodiments, the modifications may comprise fusing SEQ ID NO. 3942, and/or SEQ ID NO. 3943, to the whole or a portion of, a transmembrane domain. The IL12 may optionally be modified by incorporating a hinge domain.

In one aspect, the composition may include a first effector module (e.g., an effector module comprising IL12 or a portion thereof) and a second effector module. The second effector module may be a second SRE linked to an immunotherapeutic agent. As a non-limiting example, the immunotherapeutic agent is IL15 or an IL15/IL15Ra fusion polypeptide.

In one aspect, the SRE of the composition may stabilize the immunotherapeutic agent by a stabilization ratio of 1 or more. The stabilization ratio may comprise the ratio of expression, function or level of the immunotherapeutic agent in the presence of the stimulus to the expression, function or level of the immunotherapeutic agent in the absence of the stimulus.

In one aspect, the SRE of the composition may destabilize the immunotherapeutic agent by a destabilization ratio between 0, and 0.09. The destabilization ratio may comprise the ratio of expression, function or level of an immunotherapeutic agent in the absence of the stimulus specific to the SRE to the expression, function or level of the immunotherapeutic agent that is expressed constitutively, and in the absence of the stimulus specific to the SRE.

The present invention also provides polynucleotides comprising the compositions of the invention.

In one aspect, the polynucleotides may be a DNA or RNA molecule. In one aspect, the polynucleotides may comprise spatiotemporally selected codons. In one aspect, the polynucleotides of the invention may be a DNA molecule. In some embodiments, the polynucleotides may be an RNA molecule. In one aspect, the RNA molecule may be a messenger molecule. In some embodiments, the RNA molecule may be chemically modified.

In some embodiments, the polynucleotides may further comprise, at least one additional feature selected from, but not limited to, a promoter, a linker, a signal peptide, a tag, a cleavage site and a targeting peptide.

The present invention also provides vectors comprising polynucleotides described herein. In one aspect, the vector may be a viral vector. In some embodiments, the viral vector may be a retroviral vector, a lentiviral vector, a gamma retroviral vector, a recombinant AAV vector, an adeno viral vector, and an oncolytic viral vector.

The present invention also provides immune cells for adoptive cell transfer (ACT) which may express the compositions of the invention, the polynucleotides described herein. In one aspect, the immune cells may be infected or transfected with the vectors described herein. The immune cells for ACT may be selected from, but not limited to a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

In some embodiments, the immune cells may be autologous, allogeneic, syngeneic, or xenogeneic in relation to a particular individual subject.

The present invention provides methods for reducing a tumor volume or burden in a subject comprising contacting the subject with the immune cells of the invention. Also provided herein, is a method for inducing an anti-tumor immune response in a subject, comprising administering the immune cells of the system to the subject.

The present invention also provides methods for enhancing the expansion and/or survival of immune cells, comprising contacting the immune cells with the compositions of the invention, the polynucleotides of the invention, and/or the vectors of the invention.

Also provided herein, is a method for inducing an immune response in a subject, administering the compositions of the invention, the polynucleotides of the invention, and/or the immune cells of the invention to the subject.

In some embodiments, the effector module comprises a stimulus response element (SRE) and at least one payload comprising a protein of interest (POI).

In some embodiments, the SRE may be a destabilizing domain (DD). In some examples, the DD is a mutant domain derived from a protein such as FKBP (FK506 binding protein), E. coli DHFR (Dihydrofolate reductase) (ecDHFR), human DHFR (hDHFR), or any protein of interest. In this context, the biocircuit system is a DD biocircuit system.

The payload may be any immunotherapeutic agent used for cancer immunotherapy such as a cytokine. In one embodiment, the cytokine may be IL12. The SRE and payload may be operably linked through one or more linkers and the positions of components may vary within the effector module.

In some embodiments, the effector module may further comprise one or more additional features such as linker sequences (with specific sequences and lengths), cleavage sites, regulatory elements (that regulate expression of the protein of interest such as microRNA targeting sites), signal sequences that lead the effector module to a specific cellular or subcellular location, penetrating sequences, or tags and biomarkers for tracking the effector module.

In some embodiments, the DD may stabilize the immunotherapeutic agent with a stabilization ratio of at least one in the presence of the stimulus. According to the present invention, the DD may destabilize the immunotherapeutic agent in the absence of ligand with a destabilization ratio between 0, and 0.99.

The invention provides isolated biocircuit polypeptides, effector modules, stimulus response elements (SREs) and payloads, as well as polynucleotides encoding any of the foregoing; vectors comprising polynucleotides of the invention; and cells expressing polypeptides, polynucleotides and vectors of the invention. The polypeptides, polynucleotides, viral vectors and cells are useful for inducing anti-tumor immune responses in a subject.

In some embodiments, the vector of the invention is a viral vector. The viral vector may include, but is not limited to a retroviral vector, an adenoviral vector, an adeno-associated viral vector, or a lentiviral vector.

In some embodiments, the vector of the invention may be a non-viral vector, such as a nanoparticles and liposomes.

The present invention also provides immune cells engineered to include one or more polypeptides, polynucleotides, or vectors of the present invention. The cells may be immune effector cells, including T cells such as cytotoxic T cells, helper T cells, memory T cells, regulatory T cells, natural killer (NK) cells, NK T cells, cytokine-induced killer (CIK) cells, cytotoxic T lymphocytes (CTLs), and tumor infiltrating lymphocytes (TILs). The engineered cell may be used for adoptive cell transfer for treating a disease (e.g., a cancer).

Also provided herein are compositions and vectors containing a second effector module comprising second a stimulus response element (SRE) and at least second immunotherapeutic agent. In some embodiments, the immunotherapeutic agent may IL15 or IL15/IL15Ra fusion polypeptide.

The present invention also provides methods for inducing immune responses in a subject using the compositions of the invention. Also provided are methods for reducing a tumor burden in a subject using the compositions of the invention.

Provided herein are methods for tuning the expression and function of immunotherapeutic agent in cells or subjects. Such method may involve the administering effector modules containing an SRE operably linked to an immunotherapeutic agent. In some embodiments, the immunotherapeutic agent is IL12. In some embodiments, the SRE is derived from FKBP, DHFR, PDE5, PPAR gamma, CA2 and NQO2. Methods for pulsatile regulation of an immunotherapeutic agent using compositions described herein are also provided.

The present invention provides compositions and methods for immunotherapy. The compositions relate to tunable systems and agents that induce anti-cancer immune responses in a cell or in a subject. The tunable system and agent may be a biocircuit system comprising at least one effector module that is responsive to at least one stimulus. The biocircuit system may be, but is not limited to, a destabilizing domain (DD) biocircuit system, a dimerization biocircuit system, a receptor biocircuit system, and a cell biocircuit system. These systems are further taught in co-owned U.S. Provisional Patent Application No. 62/320,864 filed Apr. 11, 2016, 62/466,596 filed Mar. 3, 2017 and the International Publication WO2017/180587 (the contents each of which are herein incorporated by reference in their entirety).

In some embodiments, the composition for inducing an immune response may comprise a first effector module. In some embodiments, the effector module may comprise a first stimulus response element (SRE) operably linked to at least one payload. In one aspect, the payload may be an immunotherapeutic agent.

In some embodiments, the immunotherapeutic agent may be selected from, but is not limited to a cytokine, a safety switch, a regulatory switch, a chimeric antigen receptor and combinations thereof.

In one aspect, the first SRE of the composition may be responsive to or interact with at least one stimulus.
In some embodiments, the first SRE may comprise a destabilizing domain (DD). The DD may be derived from a parent protein or from a mutant protein having one, two, there, or more amino acid mutations compared to the parent protein. In some embodiments, the parent protein may be selected from, but is not limited to, human protein FKBP, comprising the amino acid sequence of SEQ. ID NO. 3944; human DHFR (hDHFR), comprising the amino acid sequence of SEQ. ID NO. 3945; *E. Coli* DHFR, comprising the amino acid sequence of SEQ. ID NO. 3946; PDE5, comprising the amino acid sequence of SEQ. ID NO. 3947; PPAR, gamma comprising the amino acid sequence of SEQ. ID NO. 3948; CA2, comprising the amino acid sequence of SEQ. ID NO. 3949; or NQO2, comprising the amino acid sequence of SEQ. ID NO. 3950.

In one aspect, the parent protein is hDHFR and the DD comprises a mutant protein having at least one mutation selected from M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38M, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In one aspect, the stimulus of the SRE may be Trimethoprim or Methotrexate.

In some embodiments, the immunotherapeutic agent may be a cytokine. In one aspect, the cytokine may be an interleukin, an interferon, a tumor necrosis factor, a transforming growth factor B, a CC chemokine, a CXC chemokine, a CX3C chemokine or a growth factor. In some embodiments, the cytokine is an interleukin. In some embodiments, the interleukin is selected from a group consisting of IL1, L1-alpha, L1-beta, IL1-delta, IL1-epsilon, L1-eta, L1-zeta, IL-RA, IL2, IL3, IL4, IL5, IL6, IL7, IL8, IL9, IL10, IL10C, IL10D, IL11a, IL11b, IL13, IL14, IL16, IL17, IL-17A, IL17B, IL17C, IL17E, IL17F, IL18, IL19, IL20, IL20L, IL21, IL22, IL23, IL23A, IL24, IL25, IL26, IL27, IL28, IL29, IL30, IL31, IL32, IL33, IL34, IL36α, IL36β, IL36γ, IL36RN, IL37, IL37a, IL37b, IL37c, I137d, IL37e, and IL38.

In one aspect, the interleukin may be IL2, comprising the amino acid sequence of SEQ ID NO. 3951.

In one aspect, the immunotherapeutic agent may be a safety switch. In some embodiments, the safety switch may be selected from a Caspase 9, an inducible FAS (iFAS), an inducible caspase 9 (icasp9), a CD20/anti-CD20 antibody pair, a protein tag/anti-tag antibody, and a compact suicide gene (RQR8). In one aspect, the safety switch may be Caspase 9 comprising the amino acid sequence of SEQ ID NO. 3952.

In one aspect, the immunotherapeutic agent may encode a regulatory switch. In some embodiments, the regulatory switch may be selected from a FOXP3, a Nr4a, a FOXO, and a NF-κB. In one aspect, the regulatory switch may be a FOXP3, comprising the amino acid sequence of SEQ ID NO. 3953-3956.

In one aspect, the immunotherapeutic agent may be a chimeric antigen receptor (CAR). In some embodiments, the CAR may be selected from a GD2 CAR, a Her2 CAR, a BCMA CAR, a CD33 CAR, an ALK CAR, a CD22 CAR, and a CD276 CAR. The CARs described herein may comprise an extracellular moiety, a transmembrane domain, an intracellular signaling domain, and optionally, one or more co-stimulatory domains.

In one aspect, the CAR may be selected from, but is not limited, to a standard CAR, a split CAR, an off-switch CAR, an on-switch CAR, a first-generation CAR, a second-generation CAR, a third-generation CAR, or a fourth-generation CAR.

In some embodiments, the extracellular target moiety of the CAR may be selected from, but is not limited to an Ig NAR, a Fab fragment, a Fab' fragment, a F(ab)'2 fragment, a F(ab)'3 fragment, an Fv, a single chain variable fragment (scFv), a bis-scFv, a (scFv)2, a minibody, a diabody, a triabody, a tetrabody, an intrabody, a disulfide stabilized Fv protein (dsFv), a unibody, a nanobody, and an antigen binding region derived from an antibody that may specifically bind to any of a protein of interest, a ligand, a receptor, a receptor fragment or a peptide aptamer.

In some embodiments, the extracellular target moiety may be selected from an ALK target moiety, comprising the amino acid sequence of SEQ ID NO. 3957-3972 and 3973-3980, a CD22 target moiety, comprising the amino acid sequence of SEQ ID NO. 3981, 775-777 and 2742, and 3982-3984, a CD276 target moiety, comprising the amino acid sequence of SEQ ID NO. 3985-3992, and 3993-3996, a GD2 target moiety, comprising the amino acid sequence of SEQ ID NO. 3997-4075, and 4075-4104, a CD33 target moiety, comprising the amino acid sequence of SEQ ID NO. 4105-4112, a BCMA target moiety, comprising the amino acid sequence of SEQ ID NO 4113-4120, and a Her2 target moiety, comprising the amino acid sequence of SEQ ID NO. 4121-4176, and 4177-4184.

In some embodiments, the intracellular signaling domain of the CAR may be derived from T cell receptor CD3zeta or a cell surface molecule selected from the group consisting of FcR gamma, FcR beta, CD3 gamma, CD3 delta, CD3 epsilon, CD5, CD22, CD79a, CD79b, and CD66d.

In some embodiments, the CAR may comprise a co-stimulatory domain. The costimulatory domain may be selected from the group consisting of 2B4, HVEM, ICOS, LAG3, DAP10, DAP12, CD27, CD28, 4-1BB (CD137), OX40 (CD134), CD30, CD40, ICOS (CD278), glucocorticoid-induced tumor necrosis factor receptor (GITR), lymphocyte function-associated antigen-1 (LFA-1), CD2, CD7, LIGHT, NKG2C, and B7-H3.

In one embodiment, the transmembrane domain of the CAR may be derived from a transmembrane domain. In one aspect, the transmembrane domain may comprise the amino acid sequence selected from, but not limited to SEQ ID NO. 981-1030, 1032-1078 and 2743.

In some embodiments, the CAR of the effector module may further comprise a hinge region near the transmembrane domain. In one aspect, the hinge region may comprise an amino acid sequence selected from the group consisting of any of SEQ ID NOs. 109-117, 119-422, 424-633, 635-773, 775-1030, 1032-1145, 2738-2739 and 2741-2743.

In one aspect, the first effector module may comprise an IL2-DD, comprising the amino acid sequence of any of SEQ ID NOs. 4185-4187.

In one aspect, the first effector module may comprise a Caspase 9-DD, comprising the amino acid sequence of any of SEQ ID NOs. 4188-4196.

In one aspect, the first effector module may comprise a FOXP3-DD, comprising the amino acid sequence of any of SEQ ID NOs. 4197-4206.

In one aspect, the first effector module may comprise a BCMA CAR-DD, comprising the amino acid sequence of any of SEQ ID NOs. 4207-4209.

In one aspect, the first effector module may comprise a HER2-DD, comprising the amino acid sequence of any of SEQ ID NO. 4210.

The present invention, also provides polynucleotides encoding the compositions of the invention.

In one aspect, the polynucleotides may be a DNA or RNA molecule. In one aspect, the polynucleotides may comprise spatiotemporally selected codons. In some embodiments, the polynucleotides may be an RNA molecule. In one aspect, the RNA molecule may be a messenger molecule. In some embodiments, the RNA molecule may be chemically modified. In some embodiments, the polynucleotides may comprise spatiotemporally selected codons.

In some embodiments, the polynucleotides may further comprise, at least one additional feature selected from, but not limited to, a promoter, a linker, a signal peptide, a tag, a cleavage site and a targeting peptide.

The present invention also provides vectors comprising polynucleotides described herein. In one aspect, the vector may be a viral vector. In some embodiments, the viral vector may be a retroviral vector, a lentiviral vector, a gamma retroviral vector, a recombinant AAV vector, an adeno viral vector, and an oncolytic viral vector.

The present invention also provides immune cells for adoptive cell transfer (ACT) which may express the compositions of the invention, the polynucleotides described herein. In one aspect, the immune cells may be infected or transfected with the vectors described herein. The immune cells for ACT may be selected from, but not limited to a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

In one aspect, the immune cell may comprise a destabilizing domain DD, wherein the DD is derived from human protein FKBP comprising the amino acid sequence of SEQ ID NO. 4211, DHFR comprising the amino acid sequence of SEQ ID NO. 4212-4213, PDE5 comprising the amino acid sequence of SEQ ID NO. 4214, PPAR gamma comprising the amino acid sequence of SEQ ID NO. 4215, CA2 comprising the amino acid sequence of SEQ ID NO. 4216 and NQO2 comprising the amino acid sequence of SEQ ID NO. 4217.

In one aspect, the DD may be derived from a parent protein and the parent protein is hDHFR and the DD comprises a mutant protein having at least one mutation selected from M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In some embodiments, the immune cells may be autologous, allogeneic, syngeneic, or xenogeneic in relation to a particular individual subject.

The present invention provides methods for reducing a tumor volume or burden in a subject comprising contacting the subject with the immune cells of the invention. Also provided herein, is a method for inducing an anti-tumor immune response in a subject, comprising administering the immune cells of the system to the subject.

Also provided herein, is a method for inducing an immune response in a subject, administering the compositions of the invention, the polynucleotides of the invention, and/or the immune cells of the invention to the subject.

The present invention also provides methods for preventing or reversing T cell exhaustion in a subject in need thereof. Such methods may comprise administering to the subject, a therapeutically effective amount of compositions described herein, the polynucleotides of the invention, the vectors of the invention, or the immune cells described herein. Such methods may comprise an SRE that responds to a stimulus and tunes the expression and/or function of the immunotherapeutic agent, thereby preventing or reversing T cell exhaustion.

In some aspects, the immunotherapeutic agent is a chimeric antigen receptor. In some embodiments, the chimeric antigen receptor may be a GD2 CAR, a BCMA CAR, a CD33 CAR, a Her2 CAR, an ALK CAR, a CD22 CAR, or a CD276 CAR.

Also provided herein, is a method for detecting cancer in a mammal, comprising the steps of (a) contacting a sample comprising one or more cells from the mammal with the compositions, the polynucleotides, the vector or the immune cells of the invention, and (b) detecting the complex, wherein the detection of the complex may be indicative of the presence of cancer in the mammal.

In some embodiments, the effector module comprises a stimulus response element (SRE) and at least one payload comprising a protein of interest (POI).

In some embodiments, the SRE may be a destabilizing domain (DD). In some examples, the DD is a mutant domain derived from a protein such as FKBP (FK506 binding protein), *E. coli* DHFR (Dihydrofolate reductase) (ecDHFR), human DHFR (hDHFR), or any protein of interest. In this context, the biocircuit system is a DD biocircuit system.

The payload may be any immunotherapeutic agent used for cancer immunotherapy such as a cytokine such as IL2, a safety switch such as Caspase 9, a regulatory switch encoding FOXP3, a chimeric antigen receptor such as BCMA CAR, CD33 CAR, GD2 CAR, Her2 CAR, ALK CAR, CD22 CAR, CD276 CAR or any agent that can induce an immune response. The SRE and payload may be operably linked through one or more linkers and the positions of components may vary within the effector module.

In some embodiments, the effector module may further comprise of one or more additional features such as linker sequences (with specific sequences and lengths), cleavage sites, regulatory elements (that regulate expression of the protein of interest such as microRNA targeting sites), signal sequences that lead the effector module to a specific cellular or subcellular location, penetrating sequences, or tags and biomarkers for tracking the effector module.

The invention provides isolated biocircuit polypeptides, effector modules, stimulus response elements (SREs) and payloads, as well as polynucleotides encoding any of the foregoing; vectors comprising polynucleotides of the invention; and cells expressing polypeptides, polynucleotides and vectors of the invention. The polypeptides, polynucleotides, viral vectors and cells are useful for inducing anti-tumor immune responses in a subject.

In some embodiments, the vector of the invention is a viral vector. The viral vector may include, but is not limited to a retroviral vector, an adenoviral vector, an adeno-associated viral vector, or a lentiviral vector.

In some embodiments, the vector of the invention may be a non-viral vector, such as a nanoparticles and liposomes.

The present invention also provides immune cells engineered to include one or more polypeptides, polynucleotides, or vectors of the present invention. The cells may be immune effector cells, including T cells such as cytotoxic T cells, helper T cells, memory T cells, regulatory T cells, natural killer (NK) cells, NK T cells, cytokine-induced killer (CIK) cells, cytotoxic T lymphocytes (CTLs), and tumor infiltrating lymphocytes (TILs). The engineered cell may be used for adoptive cell transfer for treating a disease (e.g., a cancer).

The present invention also provides methods for inducing immune responses in a subject using the compositions of the invention. Also provided are methods for reducing a tumor burden in a subject using the compositions of the invention and methods for preventing or reversing T cell exhaustion.

BRIEF DESCRIPTION OF THE DRAWINGS

FIG. 7A and FIG. 7B show that a[[A]] transmembrane effector module is activated either by a free stimulus (FIG. 7A) or a membrane bound stimulus (FIG. 7B) which binds to SRE. The response to the stimulus causes the cleavage of the intracellular signal/payload, which activates down-stream effector/payload.

FIG. 16A shows normal T cell activation which entails a dual activation of TCR and co-stimulatory receptor. The regular CAR design (FIG. 16B) combines the antigen recognition domain with TCR signaling motif and co-stimulatory motif in a single molecule. The split CAR system (FIG. 16C) separates the components of the regular CAR into two separate effector modules which can be reassembled when a heterodimerizing small molecule (stimulus) is present.

FIG. 18A-FIG. 18C show if [[If]] a normal cell has no stimulus (e.g., an antigen) (FIG. 18A) or an antigen that cannot bind to the trans-membrane effector module (FIG. 18B), or only an antigen that activates the trans-membrane effector module and primes the receiver T cell to express the second effector (FIG. 18C), the receiver T cell remains inactive. When both stimuli (e.g. two antigens) that bind the trans-membrane effector module and the primed effector, are present on the presenter cell (e.g. a cancer cell), the T cell is activated (FIG. 18D).

FIG. 20A shows GFP intensity of hDHFR mutants in the absence of ligand as measured by FACS. FIG. 20B shows GFP intensity of hDHFR mutants in the presence of ligand as measured by FACS.

FIG. 21A shows MTX titration with hDHFR mutant as measured by FACS. FIG. 21B shows TMP titration with hDHFR mutant as measured by FACS.

FIG. 24A is a western blot of IL15 protein levels in 293T cells. FIG. 24B and FIG. 24C are histograms depicting surface expression of IL15 and IL15Ra respectively. FIG. 24D is a western blot of IL15 and hDHFR in HCT116 cells.

FIG. 25A and FIG. 25B show the sequence alignment of wildtype DHFR (SEQ ID NO. 4218) with hDHFR mutants. FIG. 25A and FIG. 25B disclose SEQ ID NOS 3093-3094, respectively, in order of appearance.

FIG. 28A shows the expression of CD19 chimeric antigen receptors in a western blot using CD3 Zeta antibody. FIG. 28B shows the expression of CD19 chimeric antigen receptors in a western blot using 4-1BB antibody.

FIG. 29A and FIG. 29B are western blots depicting the protein levels of CD3 Zeta of the DD-CD19 CAR construct and actin. FIG. 29C shows the expression of CD19 chimeric antigen receptors in a western blot using 4-1BB antibody. FIG. 29D is a bar graph depicting the surface expression of CD19 CAR.

FIG. 30A shows the expression of DHFR mutants with increasing concentrations of Trimethoprim in a western blot using GFP antibody. FIG. 30B shows the expression of DHFR mutants with increasing concentrations of Methotrexate in a western blot using GFP antibody.

FIG. 31A is a bar graph depicting IL12 levels in the various dilutions of media derived from cells expressing DD-IL12. FIG. 31B is a bar graph depicting the Shield-1 dose responsive induction of DD-IL12.

FIG. 31C depicts plasma IL12 levels in mice implanted with SKOV3 cells. FIG. 31D depicts plasma IL12 levels in mice in response to different Shield-1 dosing regimens.

FIG. 33A depicts IFN gamma production in T cells. FIG. 33B depicts T cell expansion with IL15/IL15Ra treatment. FIG. 33C is a dot plot depicting percentage human cells after in vivo cell transfer. FIG. 33D is a scatter plot depicting CD4+/CD8+ T cells.

FIG. 34A depicts T cell subpopulations expressing CD19 CAR. FIG. 34B depicts cell death caused by CD19 CAR expressing T cells.

FIG. 35A is a bar graph depicting IL15Ra positive cells with 24 hour TMP treatment. FIG. 35B is a bar graph depicting IL15Ra positive cells with 48 hour TMP treatment. FIG. 35C is a bar graph depicting IL15Ra positive cells in response to varying concentrations of TMP.

FIG. 36A represents percentage of human T cells in blood with respect to mouse T cells. FIG. 36B represents the number of T cells in blood. FIG. 36C represents ratio of CD4 to CD8 cells in the blood. FIG. 36D represents the percentage of IL15Ra positive CD4 and CD8 T cells in the blood.

FIG. 37A depicts the expansion of T cells in response to cytokine treatment. FIG. 37B-FIG. 37D depict the frequency of IFN gamma positive cells with IL12 treatment.

FIG. 39A shows the expression of CD19 in parental K562 cells and K562-CD19 cells. FIG. 39B shows the proliferation of K562 cells cocultured with T cells expressing DD regulated CAR constructs, in the presence or absence of ligand. FIG. 39C shows the area of target cells killed by T cells expressing DD regulated CAR constructs, in the presence of ligand.

FIG. 40A shows IFNgamma concentration.

FIG. 40B shows IL2 concentration.

FIG. 41A provides the final IL12 concentration for each of the four groups tested. FIG. 41B-FIG. 41C show that IL12 is detectable in kidney (FIG. 41B) and that IL12 is detectable in tumor (FIG. 41C).

FIG. 42A shows the regulation of IL12 over 24 hours. FIG. 42B shows the regulation in the plasma and FIG. 42C shows the detection of flexi-IL12 in the kidneys.

FIG. 43A shows that restimulation increased the expression of IL12. FIG. 43B and FIG. 43C show that ligand increased production of IL12.

FIG. 44A shows the concentration-dependent induction of IL12 secretion from primary human T cells. FIG. 44B shows the time course induction of IL12 secretion from primary human T cells.

FIG. 45A shows the dose response of Aquashield-Induced DD-IL12 regulation in vivo. FIG. 45B shows that plasma levels of IL12 remain high in animals transplanted with constitutive IL12 transduced T cells.

FIG. 46A-FIG. 46B show the expression of IL12 in vivo over 7 days. FIG. 46C-FIG. 46D show the expression of IL12 in vivo over 11 days. FIG. 46E shows the Geometric MFI (GeoMFI) of Granzyme B (GrB) after 7 days in CD8+ T cells. FIG. 46F shows the GeoMFI of Perforin at day 7 in CD8+ T cells.

FIG. 47A shows the regulation of IL12 with PGK and EF1a promoters and FKBP domains. FIG. 47B shows the relative expression of IL12.

FIG. 51A provides FACS plots showing the expression of membrane bound IL15 after a dose response study of TMP. FIG. 51B is two graphs showing the dose and time of exposure of TMP in vitro influences membrane bound IL15 expression.

FIG. 52A-FIG. 52C show the regulation of membrane bound IL15 using IL15 (FIG. 52A), IL15Ra (FIG. 52B), or IL15/IL15Ra double ++ staining (FIG. 52C). FIG. 52D shows FACS plots of the expression of IL15. FIG. 52E is a graph of the regulation of IL15 in blood and FIG. 52F is a graph of the plasma TMP levels.

FIG. 53 represents the regulation of membrane bound IL15 with PO or IP dosing of TMP.

FIG. 54A is a western blot of IL15Ra protein levels in HCT116 cells. IL15 levels in the media measured by ELISA are represented in FIG. 54B and levels measured using the MSD assay are presented in FIG. 54C.

FIG. 55A represents the tumor growth of HCT116 cells in xenograft assays. FIG. 55B represents tumor growth of HCT 116 cells expressing IL15/IL15Ra fusion constructs with ligand treatment.

FIG. 57A and FIG. 57B depict the effect of promoter on IL12 levels. FIG. 57C depicts the effect of ligand concentration and promoter on IL12 levels. FIG. 57D shows the effect of promoter on IL12 levels in HCT116 cells. FIG. 57E depicts IL12 levels in Raji cells.

FIG. 59A is a western blot depicting luciferase levels in DD-luciferase expressing cells. FIG. 59B depicts luciferase activity.

FIG. 60A and FIG. 60B are western blots depicting DD regulated expression of FOXP3.

DETAILED DESCRIPTION OF THE INVENTION

Figure 1:
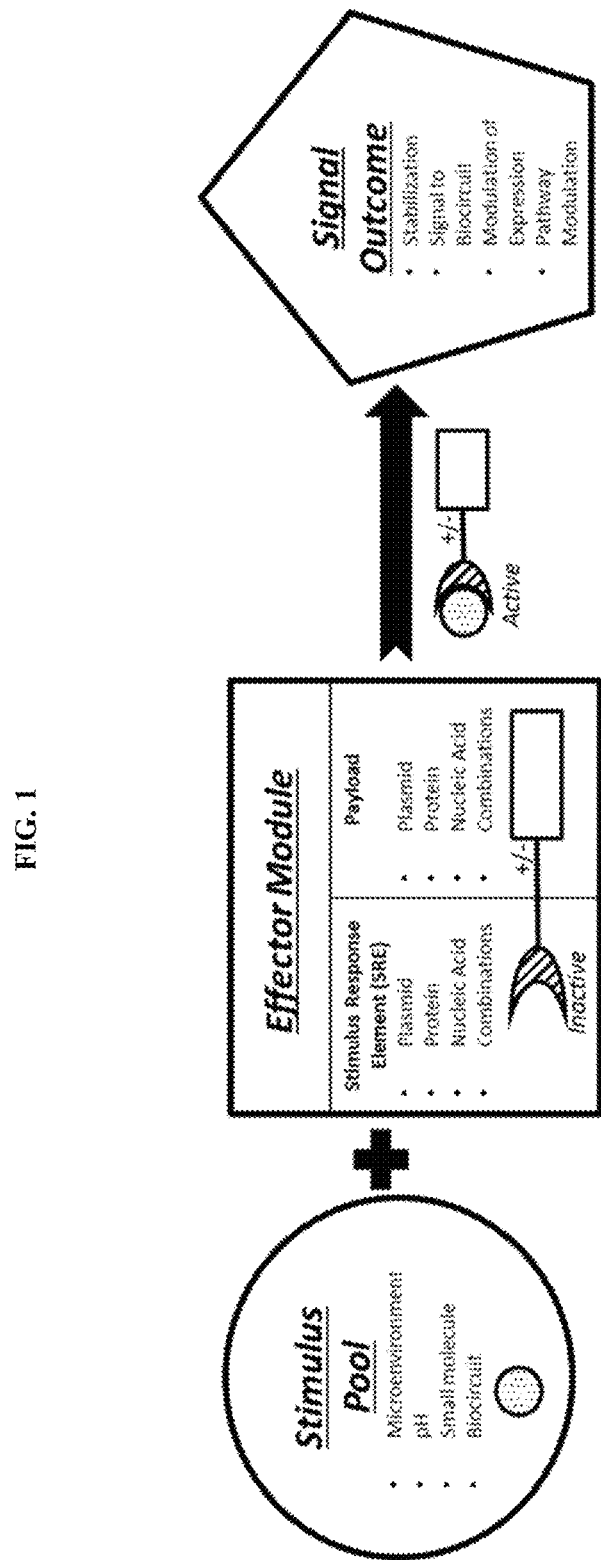
FIG. 1 shows an overview diagram of a biocircuit system of the invention. The biocircuit comprises a stimulus and at least one effector module responsive to a stimulus, where the response to the stimulus produces a signal or outcome. The effector module comprises at least one stimulus response element (SRE) and one payload.

The details of one or more embodiments of the invention are set forth in the accompanying description below. Although any materials and methods similar or equivalent to those described herein can be used in the practice or testing of the present invention, the preferred materials and methods are now described. Other features, objects and advantages of the invention will be apparent from the description. In the description, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present description will control.

I. Introduction

Protein Regulation

The ability to conditionally control protein levels is a powerful tool in gene and cell therapy. Techniques to control protein expression on a genetic level have been widely studied. The Cre-Lox technology provides a useful approach to activate or inactivate genes. Tissue or cell specific promoters can be used to control spatial and temporal expression of genes of interest. However, this system is limited in application due to the irreversible nature of the perturbation. The transcription of the gene of interest can be conditionally regulated using tools such as Doxycycline (Dox)-inducible system. Alternatively, the stability of mRNA can be regulated using RNA interference techniques. However, methods targeting DNA or RNA are slow acting, irreversible and have low efficiency.

Direct manipulation of activities at the protein level provides significant advantages in flexibility, reversibility and speed. Strategies which directly trigger a cell's natural degradation system have been developed. Szostak and colleagues showed that a small peptide sequence could be fused to the N-terminus of a protein of interest to modulate protein stability (Park, E-C., et al., *Proc. Natl. Acad. Sci. U.S.A.* 1992, 89:1249-1252). Varshavsky and coworkers isolated a temperature-sensitive peptide sequence that greatly reduced the half-life of dihydrofolate reductase (DHFR) at the non-permissive temperatures (Dohmen et al. *Science* 1994, 263: 1273-1276). These mutants have been widely used to study protein functions in yeast (Labib et al. *Science* 2000, 288: 1643-1646; and Kanemaki et al. *Nature* 2003, 423:720-724).

Subsequently, reversible systems employing a rapamycin derivative for the regulation of GSK-3β kinase fused to an unstable triple-mutant of the FRB domain (FRB*) were developed. The rapamycin derivative induces dimerization of the FRB*-GSK-3β and endogenous FKBP12 and stabilizes the FRB* fusion thus restoring the function of the fused kinase. (Stankunas et al., Mol Cell. 2003; 12:1615-1624 and Liu et al., Nature. 2007; 446:79-82).

Building on the FRB* domain system, Banaszynski, et al., developed a cell-permeable ligand system using mutants of FKBP12 protein which were engineered to be unstable in the absence of a high-affinity ligand, Shield-1. (Banaszynski et al., Cell. 2006; 126:995-1004). They termed these unstable domains, destabilizing domains (DDs).

The FKBP/shield-1 tuning system has been successfully used in several studies to control target proteins. For example, Dettwier et al., fused FKBP to tune the express of NADPH P450 oxidoreductase (POR) (Dettwier et al., *PLoS One,* 2014, 9(11): e113540).

The FKBP DD-shield system has been used in cell lines, transgenic mice, protozoan *Entamoeba histolytica*, the flatworm *Caenorhabditis elegans*, the medaka, and transgenic xenografts to investigate the activity of a protein of interest (Maynard-Smith et al., *J Biol Chem.* 2007, 282(34): 24866-24872; Liu et al., *Int J Parasitol.* 2014, 44(10):729-735; Cho et al., *PLoS One.* 2013, 8(8): e72393); Banaszynski et al. *Nat Med.* 2008, 14(10):1123-1127; Rodriguez and Wolfgang, *Chem Biol.* 2011, 19(3):391-398; and Froschauer et al., *PLoS One,* 2015, 10(7): e0131252), for iPSC reprogramming (Sui et al., Stem cell Reports., 2014, 2(5): 721-733).

In addition, the destabilizing domain has been used for the conditional knock down/knock out of the target gene fused with the destabilizing domain. Park et al achieved this genomic engineering by CRISPR/Cas9-mediated homologous recombination and a donor template coding for a resistance cassette and the DD-tagged TCOF1 sequence (Park et al., *PLoS One.* 2014, 9(4): e95101).

More recently protein switches useful as biosensors as well as new chimeric antigen receptors and other small molecule stabilization frameworks have been disclosed (An W, et al. *PLoS ONE,* 2015, 10(12): e0145783. doi: 10.1371/journal.pone.0145783; Nicholes, et al., *Protein Engineering, Design & Selection,* 2016, vol. 29 no. 2, pp. 77-85; Nath, et al., *Biochemical and Biophysical Research Communications,* 2016, 470: 411 e416); Stevers, et al., *PNAS,* 2016, vol. 119, no. 9, pp. E112-1161; Juillerat, A. et al., *Sci. Rep.* 2016, 6: 18950; Roybal, *Cell,* 2016, vol. 164, pp. 1-10; and Morsut, *Cell,* 2016, vol. 164, pp. 1-12).

One drawback of the FKBP/Shield-1 is that Shield-1 is a novel drug whose biodistribution is not fully characterized and it is not known to what extent Shield-1 crosses the blood-brain barrier.

Other DD ligand pairs include estrogen receptor domains which can be regulated by several estrogen receptor antagonists (Miyazaki et al., J Am Chem. Soc., 2012, 134(9): 3942-3945), and fluorescent destabilizing domain (FDD) derived from bilirubin-inducible fluorescent protein, UnaG. A FDD and its cognate ligand bilirubin (BR) can induce degradation of a protein fused to the FDD (Navarro et al., ACS Chem Biol., 2016, Jun. 6, Epub). Other known DDs and their applications in protein stability include those described in U.S. Pat. Nos. 8,173,792 and 8,530,636, the contents of which are each incorporated herein by reference in their entirety.

In an orthogonal approach, the destabilizing domains of the bacterial dihydrofolate reductase (ecDHFR) were explored. (Iwamoto et al., *Chem Biol.* 2010, 17(9):981-988; and Tai et al., *PLoS One.* 2012, 7(9): e46269). Numerous inhibitors of DHFR have been developed as drugs and one such inhibitor Trimethoprim (TMP), inhibits ecDHFR much more potently than mammalian DHFR providing specificity to the interaction. Additionally, TMP is commercially available and has desirable pharmacological properties making this protein-ligand pair ideal for development for use as a biocircuit (Iwamoto, et al., Chem Biol. (2010) September 24; 17(9): 981-988).

The present invention expands upon the technology of tuning protein stability using novel destabilizing domains derived from hDHFR. The destabilization and stabilization of a protein of interest, e.g., a transgene for gene therapy, can be controlled by hDHFR mutant DDs having destabilizing or stabilizing properties and their ligands, e.g. Trimethoprim and Methotrexate specifically binding to such protein domains. The presence and/or absence of a small molecule ligand can tune the activity of a protein of interest that is genetically fused to the destabilizing domain.

Cancer immunotherapy aims' at the induction or restoration of the reactivity of the immune system towards cancer. Significant advances in immunotherapy research have led to the development of various strategies which may broadly be classified into active immunotherapy and passive immunotherapy. In general, these strategies may be utilized to directly kill cancer cells or to counter the immunosuppressive tumor microenvironment. Active immunotherapy aims at induction of an endogenous, long-lasting tumor-antigen specific immune response. The response can further be enhanced by non-specific stimulation of immune response modifiers such as cytokines. In contrast, passive immunotherapy includes approaches where immune effector molecules such as tumor-antigen specific cytotoxic T cells or antibodies are administered to the host. This approach is short lived and requires multiple applications.

Despite significant advances, the efficacy of current immunotherapy strategies is limited by associated toxicities. These are often related to the narrow therapeutic window associated with immunotherapy, which in part, emerges from the need to push therapy dose to the edge of potentially fatal toxicity to get a clinically meaningful treatment effect. Further, dose expands in vivo since adoptively transferred immune cells continue to proliferate within the patient, often unpredictably.

A major risk involved in immunotherapy is the on-target but off tumor side effects resulting from T-cell activation in response to normal tissue expression of the tumor associated antigen (TAA). Clinical trials utilizing T cells expressing T-cell receptor against specific TAA reported skin rash, colitis and hearing loss in response to immunotherapy.

Immunotherapy may also produce on target, on-tumor toxicities that emerge when tumor cells are killed in response to the immunotherapy. The adverse effects include tumor lysis syndrome, cytokine release syndrome and the related macrophage activation syndrome. Importantly, these adverse effects may occur during the destruction of tumors, and thus even a successful on-tumor immunotherapy might result in toxicity. Approaches to regulatably control immunotherapy are thus highly desirable since they have the potential to reduce toxicity and maximize efficacy.

The present invention provides systems, compositions, immunotherapeutic agents and methods for cancer immunotherapy. These compositions provide tunable regulation of gene expression and function in immunotherapy. The present invention also provides biocircuit systems, effector modules, stimulus response elements (SREs) and payloads, as well as polynucleotides encoding any of the foregoing. In one aspect, the systems, compositions, immunotherapeutic agents and other components of the invention can be controlled by a separately added stimulus, which provides a significant flexibility to regulate cancer immunotherapy. Further, the systems, compositions and the methods of the present invention may also be combined with therapeutic agents such as chemotherapeutic agents, small molecules, gene therapy, and antibodies.

The tunable nature of the systems and compositions of the invention has the potential to improve the potency and duration of the efficacy of immunotherapies. Reversibly silencing the biological activity of adoptively transferred cells using compositions of the present invention allows maximizing the potential of cell therapy without irretrievably killing and terminating the therapy.

The present invention provides methods for fine tuning of immunotherapy after administration to patients. This in turn improves the safety and efficacy of immunotherapy and increases the subject population that may benefit from immunotherapy.

II. Compositions of the Invention

According to the present invention, biocircuit systems are provided which comprise, at their core, at least one effector module system. Such effector module systems comprise at least one effector module having associated, or integral therewith, one or more stimulus response elements (SREs). The overall architecture of a biocircuit system of the invention is illustrated in FIG. 1. In general, a stimulus response element (SRE) may be operably linked to a payload construct which could be any protein of interest (POI) (e.g., an immunotherapeutic agent), to form an effector module. The SRE, when activated by a particular stimulus, e.g., a small molecule, can produce a signal or outcome, to regulate transcription and/or protein levels of the linked payload either up or down by perpetuating a stabilizing signal or destabilizing signal, or any other types of regulation. A much-detailed description of a biocircuit system can be found in U.S. Provisional Patent Application No. 62/320,864 filed Apr. 11, 2016 or in U.S. Provisional Application No. 62/466,596 filed Mar. 3, 2017 and the International Publication WO2017/180587 (the contents of each of which are herein incorporated by reference in their entirety). In accordance with the present invention, biocircuit systems, effector modules, SREs and components that tune expression levels and activities of any agents used for immunotherapy are provided.

According to the present invention, biocircuit systems are provided which comprise, at their core, at least one effector module system. Such effector module systems comprise at least one effector module having associated, or integral therewith, one or more stimulus response elements (SREs). The overall architecture of a biocircuit system of the invention is illustrated in FIG. 1. In general, a stimulus response element (SRE) may be operably linked to a payload construct which could be any protein of interest (POI) (e.g., an immunotherapeutic agent), to form an effector module. The SRE, when activated by a particular stimulus, e.g., a small molecule, can produce a signal or outcome, to regulate transcription and/or protein levels of the linked payload either up or down by perpetuating a stabilizing signal or destabilizing signal, or any other types of regulation. A much-detailed description of a biocircuit system are taught in co-owned U.S. Provisional Patent Application No. 62/320,864 filed Apr. 11, 2016, 62/466,596 filed Mar. 3, 2017 and the International Publication WO2017/180587 (the contents each of which are herein incorporated by reference in their entirety). In accordance with the present invention, biocircuit systems, effector modules, SREs and components that tune expression levels and activities of any agents used for immunotherapy are provided.

As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present invention and effect signals or outcomes in acellular environments such as with diagnostic, reporter systems, devices, assays or kits. The artificial circuits may be associated with one or more electronic, magnetic, or radioactive components or parts.

In accordance with the present invention, a biocircuit system may be a destabilizing domain (DD) biocircuit system, a dimerization biocircuit system, a receptor biocircuit system, and a cell biocircuit system. Any of these systems may act as a signal to any other of these biocircuit systems.

Effector Modules and SREs for Immunotherapy

In accordance with the present invention, biocircuit systems, effector modules, SREs, and components that tune expression levels and activities of any agents used for immunotherapy are provided. As non-limiting examples, an immunotherapeutic agent may be an antibody and fragments and variants thereof, a cancer specific T cell receptor (TCR) and variants thereof, an anti-tumor specific chimeric antigen receptor (CAR), a chimeric switch receptor, an inhibitor of a co-inhibitory receptor or ligand, an agonist of a co-stimulatory receptor and ligand, a cytokine, chemokine, a cytokine receptor, a chemokine receptor, a soluble growth factor, a metabolic factor, a suicide gene, a homing receptor, or any agent that induces an immune response in a cell and a subject.

As stated, the biocircuits of the invention include at least one effector module as a component of an effector module system. As used herein, an "effector module" is a single or multi-component construct or complex comprising at least (a) one or more stimulus response elements (i.e. proteins of interest (POIs). As used herein a "stimulus response element (SRE)" is a component of an effector module which is joined, attached, linked to or associated with one or more payloads of the effector module and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1% and 100% or a factored increase or decrease such as 2-fold, 3-fold, 4-fold, 5-fold, 10-fold or more.

In some embodiments, the present invention provides methods for modulating protein expression, function or level. In some aspects, the modulation of protein expression, function or level refers to modulation of expression, function or level by at least about 20%, such as by at least about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

In some embodiments, the present invention provides methods for modulating protein, expression, function or level by measuring the stabilization ratio and destabilization ratio. As used herein, the stabilization ratio may be defined as the ratio of expression, function or level of a protein of interest in response to the stimulus to the expression, function or level of the protein of interest in the absence of the stimulus specific to the SRE. In some aspects, the stabilization ratio is at least 1, such as by at least 1-10, 1-20, 1-30, 1-40, 1-50, 1-60, 1-70, 1-80, 1-90, 1-100, 20-30, 20-40, 20-50, 20-60, 20-70, 20-80, 20-90, 20-95, 20-100, 30-40, 30-50, 30-60, 30-70, 30-80, 30-90, 30-95, 30-100, 40-50, 40-60, 40-70, 40-80, 40-90, 40-95, 40-100, 50-60, 50-70, 50-80, 50-90, 50-95, 50-100, 60-70, 60-80, 60-90, 60-95, 60-100, 70-80, 70-90, 70-95, 70-100, 80-90, 80-95, 80-100, 90-95, 90-100 or 95-100. As used herein, the destabilization ratio may be defined as the ratio of expression, function or level of a protein of interest in the absence of the stimulus specific to the effector module to the expression, function or level of the protein of interest, that is expressed constitutively and in the absence of the stimulus specific to the SRE. As used herein "constitutively" refers to the expression, function or level of a protein of interest that is not linked to an SRE, and is therefore expressed both in the presence and absence of the stimulus. In some aspects, the destabilization ratio is at least 0, such as by at least 0.1, 0.2, 0.3, 0.4, 0.5, 0.6, 0.7, 0.8, 0.9, or at least, 0-0.1, 0-0.2, 0-0.3, 0-0.4, 0-0.5, 0-0.6, 0-0.7, 0-0.8, 0-0.9, 0.1-0.2, 0.1-0.3, 0.1-0.4, 0.1-0.5, 0.1-0.6, 0.1-0.7, 0.1-0.8, 0.1-0.9, 0.2-0.3, 0.2-0.4, 0.2-0.5, 0.2-0.6, 0.2-0.7, 0.2-0.8, 0.2-0.9, 0.3-0.4, 0.3-0.5, 0.3-0.6, 0.3-0.7, 0.3-0.8, 0.3-0.9, 0.4-0.5, 0.4-0.6, 0.4-0.7, 0.4-0.8, 0.4-0.9, 0.5-0.6, 0.5-0.7, 0.5-0.8, 0.5-0.9, 0.6-0.7, 0.6-0.8, 0.6-0.9, 0.7-0.8, 0.7-0.9 or 0.8-0.9.

In some embodiments, the stimulus of the present invention maybe ultrasound stimulation. In some embodiments, the SREs of the present invention may derived from mechanosensitive proteins. In one embodiment, the SRE of the present invention may be the mechanically sensitive ion channel, Piezo1.

Expression of the payload of interest in such instances is tuned by providing focused ultrasound stimulation. In other embodiments, the SREs of the present invention may be derived from calcium biosensors, and the stimulus of the present invention may calcium. The calcium may be generated by the ultrasound induced mechanical stimulation of mechanosensitive ion channels. The ultrasound activation of the ion channel causes a calcium influx thereby generating the stimulus. In one embodiment, the mechanosensitive ion channel is Piezo 1. Mechanosensors may be advantageous to use since they provide spatial control to a specific location in the body.

The SRE of the effector module may be selected from, but is not limited to, a peptide, peptide complex, peptide-protein complex, protein, fusion protein, protein complex, protein-protein complex. The SRE may comprise one or more regions derived from any natural or mutated protein, or antibody. In this aspect, the SRE is an element, when responding to a stimulus, can tune intracellular localization, intramolecular activation, and/or degradation of payloads.

In some embodiments, effector modules of the present invention may comprise additional features that facilitate the expression and regulation of the effector module, such as one or more signal sequences (SSs), one or more cleavage and/or processing sites, one or more targeting and/or penetrating peptides, one or more tags, and/or one or more linkers. Additionally, effector modules of the present invention may further comprise other regulatory moieties such as inducible promoters, enhancer sequences, microRNA sites, and/or microRNA targeting sites. Each aspect or tuned modality may bring to the effector module or biocircuit a differentially tuned feature. For example, an SRE may represent a destabilizing domain, while mutations in the protein payload may alter its cleavage sites or dimerization properties or half-life and the inclusion of one or more microRNA or microRNA binding site may impart cellular detargeting or trafficking features. Consequently, the present invention embraces biocircuits which are multifactorial in their tenability. Such biocircuits may be engineered to contain one, two, three, four or more tuned features.

In some embodiments, effector modules of the present invention may include one or more degrons to tune expression. As used herein, a "degron" refers to a minimal sequence within a protein that is sufficient for the recognition and the degradation by the proteolytic system. An important property of degrons is that they are transferrable, that is, appending a degron to a sequence confers degradation upon the sequence. In some embodiments, the degron may be appended to the destabilizing domains, the payload or both. Incorporation of the degron within the effector module of the invention, confers additional protein instability to the effector module and may be used to minimize basal expression. In some embodiments, the degron may be an N-degron, a phospho degron, a heat inducible degron, a photosensitive degron, an oxygen dependent degron. As a non-limiting example, the degron may be an Ornithine decarboxylase degron as described by Takeuchi et al. (Takeuchi J et al. (2008). Biochem J. 2008 Mar. 1; 410(2): 401-7; the contents of which are incorporated by reference in their entirety). Other examples of degrons useful in the present invention include degrons described in International patent publication Nos. WO2017004022, WO2016210343, and WO2011062962; the contents of each of which are incorporated by reference in their entirety.

A variety of strategies that can directly control protein, e.g., a transgene, expression and function are available. The present invention provides novel protein domains displaying small molecule dependent stability. Such protein domains are called destabilizing domains (DDs). In the absence of its binding ligand, the DD causes degradation of a payload such as a protein of interest (POI) that is operably linked to the DD, while in the presence of its binding ligand, the fused DD and payload can be stabilized and its stability is dose dependent.

According to the present invention, novel destabilizing domains derived from human DHFR (Dihydrofolate reductase) protein are provided, including single mutation: hDHFR (Y122I), hDHFR (K81R), hDHFR (F59S), hDHFR (I17V), hDHFR (N65D), hDHFR (A107V), hDHFR (N127Y), hDHFR (K185E), hDHFR (N186D), and hDHFR (M140I); double mutations: hDHFR (M53T, R138I), hDHFR (V75F, Y122I), hDHFR (A125F, Y122I), hDHFR (L74N, Y122I), hDHFR (L94A, T147A), hDHFR (G21T, Y122I), hDHFR (V121A, Y122I), hDHFR (Q36K, Y122I), hDHFR (C7R, Y163C), hDHFR (Y178H, E181G), hDHFR (A10V, H88Y), hDHFR (T137R, F143L), hDHFR (E162G, I176F), hDHFR (T57A, I72A), hDHFR (H131R, E144G), and hDHFR (Y183H, K185E); and triple mutations: hDHFR (Q36F, N65F, Y122I), hDHFR (G21E, I72V, I176T), hDHFR (I8V, K133E, Y163C), hDHFR (V9A, S93R, P150L), hDHFR (K19E, F89L, E181G), hDHFR (G54R, M140V, S168C), hDHFR (L23S, V121A, Y157C), hDHFR (V110A, V136M, K177R), and hDHFR (N49D, F59S, D153G). These hDHFR DDs can bind to MTX and/or TMP and be stabilized in a dose dependent matter.

According to the present invention, biocircuit systems are provided which comprise, at their core, at least one effector module system. Such effector module systems comprise at least one effector module having associated, or integral therewith, one or more stimulus response elements (SREs). The overall architecture of a biocircuit system of the invention is illustrated in FIG. 1. In particular, biocircuit systems and effector modules comprising the novel destabilizing domains discussed herein are provided. In some embodiments, the SRE is hDHFR-derived SRE. In some embodiments, the effector module described herein may be a hDHFR-derived SRE operably linked to a payload.

As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present invention and effect signals or outcomes in acellular environments such as with diagnostic, reporter systems, devices, assays or kits. The artificial circuits may be associated with one or more electronic, magnetic, or radioactive components or parts. A much-detailed description of a biocircuit system can be found in International Publication No. WO2017180587 (the contents of which are herein incorporated by reference in their entirety).

In one aspect of the present invention, the biocircuit system is a DD biocircuit system.

As used herein, an "effector module" is a single or multi-component construct or complex comprising at least (a) one or more stimulus response elements (SREs) and (b) one or more payloads (i.e. proteins of interest (POIs). In the context of the present invention, the SRE is a DD.

As used herein a "payload" or "target payload" is defined as any protein or nucleic acid whose function is to be altered. Payloads may include any coding or non-coding gene or any protein or fragment thereof, or fusion constructs, or antibodies.

Payloads are often associated with one or more SREs (e.g., DDs) and may be encoded alone or in combination with one or more DD in a polynucleotide of the invention. Payloads themselves may be altered (at the protein or nucleic acid level) thereby providing for an added layer of tenability of the effector module. For example, payloads may be engineered or designed to contain mutations, single or multiple, which affect the stability of the payload or its susceptibility to degradation, cleavage or trafficking. The combination of a DD which can have a spectrum of responses to a stimulus with a payload which is altered to exhibit a variety of responses or gradations of output signals, e.g., expression levels, produce biocircuits which are superior to those in the art. For example, mutations or substitutional designs such as those created for IL12 in WO2016048903 (specifically in Example 1 therein), the contents of which are incorporated herein by reference in their entirety, may be used in any protein payload in conjunction with a DD of the present invention to create dual tunable biocircuits. The ability to independently tune both the DD and the payload greatly increases the scope of uses of the effector modules of the present invention.

Effector modules may be designed to include one or more payloads, one or more DDs, one or more cleavage sites, one or more signal sequences, one or more tags, one or more targeting peptides, and one or more additional features including the presence or absence of one or more linkers. Representative effector module embodiments of the invention are illustrated in FIG. 2-FIG. 6. In some aspects, the DD can be positioned at the N-terminal end, or the C-terminal end, or internal of the effector module construct. Different components of an effector module such as DDs, payloads and additional features are organized linearly in one construct, or are separately constructed in separate constructs.

Additionally, effector modules of the present invention may further comprise other regulatory moieties such as inducible promoters, enhancer sequences, microRNA sites, and/or microRNA targeting sites that provide flexibility on controlling the activity of the payload. The payloads of the present invention may be any natural proteins and their variants, or fusion polypeptides, antibodies and variants thereof, transgenes and therapeutic agents.

The stimulus of the biocircuit system may be, but is not limited to, a ligand, a small molecule, an environmental signal (e.g., pH, temperature, light and subcellular location), a peptide or a metabolite. In one aspect of the present invention, the stimulus is a DHFR DD binding ligand including methotrexate (MTX) and trimethoprim (TMP).

Polypeptides of DDs, biocircuit systems and effector modules comprising such DDs and payload constructs, other components, polynucleotides encoding these polypeptides and variants thereof, vectors comprising these polynucleotides, are provided in the present invention. The vector may be a plasmid or a viral vector including but not limited to a lentiviral vector, a retroviral vector, a recombinant AAV vector and oncolytic viral vector.

According to the present invention, biocircuit systems and effector modules of the invention can be used to regulate the expression and activity of a payload in response to the presence or absence of a ligand that specifically binds to the DD integrated within the biocircuit system and effector module.

In some aspects, DDs, effector modules and biocircuit systems of the invention may be used to regulate the expression, function and activity of a payload in a cell or a subject. The regulation refers to a lever of change of its expression, function and activity, by at least about 10%, or at least about 20%, or at least about 30%, or at least about 40%, or at least about 50%, or at least about 60%, or at least about 70%, or at least about 80%, or at least about 85%, or at least about 90%, or at least about 95%, or at least about 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

In some embodiments, the present invention provides methods for modulating protein, expression, function or level by measuring the stabilization ratio, destabilization ratio, and destabilizing mutation co-efficient. As used herein, the stabilization ratio may be defined as the ratio of expression, function or level of a protein of interest in response to the stimulus to the expression, function or level of the protein of interest in the absence of the stimulus specific to the SRE. In some aspects, the stabilization ratio is at least 1, such as by at least 1-10, 1-20, 1-30, 1-40, 1-50, 1-60, 1-70, 1-80, 1-90, 1-100, 20-30, 20-40, 20-50, 20-60, 20-70, 20-80, 20-90, 20-95, 20-100, 30-40, 30-50, 30-60, 30-70, 30-80, 30-90, 30-95, 30-100, 40-50, 40-60, 40-70, 40-80, 40-90, 40-95, 40-100, 50-60, 50-70, 50-80, 50-90, 50-95, 50-100, 60-70, 60-80, 60-90, 60-95, 60-100, 70-80, 70-90, 70-95, 70-100, 80-90, 80-95, 80-100, 90-95, 90-100 or 95-100. As used herein, the destabilization ratio may be defined as the ratio of expression, function or level of a protein of interest in the absence of the stimulus specific to the effector module to the expression, function or level of the protein of interest, that is expressed constitutively and in the absence of the stimulus specific to the SRE. As used herein "constitutively" refers to the expression, function or level a protein of interest that is not linked to an SRE or is linked to the wildtype protein from which the SRE is derived, and is therefore expressed both in the presence and absence of the stimulus. As used herein, the destabilizing mutation co-efficient may be defined as the ratio of expression or level of a protein of interest that is appended to a DD, in the absence of the stimulus specific to the effector module to the expression, function or level of the protein that is appended to the wild type protein from which the DD is derived. In some aspects, the destabilization ratio and the destabilizing mutation co-efficient is at least 0, such as by at least 0.1, 0.2, 0.3, 0.4, 0.5, 0.6, 0.7, 0.8, 0.9, or at least, 0-0.1, 0-0.2, 0-0.3, 0-0.4, 0-0.5, 0-0.6, 0-0.7, 0-0.8, 0-0.9, 0.1-0.2, 0.1-0.3, 0.1-0.4, 0.1-0.5, 0.1-0.6, 0.1-0.7, 0.1-0.8, 0.1-0.9, 0.2-0.3, 0.2-0.4, 0.2-0.5, 0.2-0.6, 0.2-0.7, 0.2-0.8, 0.2-0.9, 0.3-0.4, 0.3-0.5, 0.3-0.6, 0.3-0.7, 0.3-0.8, 0.3-0.9, 0.4-0.5, 0.4-0.6, 0.4-0.7, 0.4-0.8, 0.4-0.9, 0.5-0.6, 0.5-0.7, 0.5-0.8, 0.5-0.9, 0.6-0.7, 0.6-0.8, 0.6-0.9, 0.7-0.8, 0.7-0.9 or 0.8-0.9.

The position of the payload with respect to the DD, within the SRE may be varied to achieve optimal DD regulation. In some embodiments, the payload may be fused to the N terminus of the DD. In another embodiment, the payload may be fused to the C terminus of the DDs. An optional start codon nucleotide sequence encoding for methionine may be added to the DD and/or payload. In some embodiments, effector modules of the present invention may include one or more degrons to tune expression. As used herein, a "degron" refers to a minimal sequence within a protein that is sufficient for the recognition and the degradation by the proteolytic system. An important property of degrons is that they are transferrable, that is, appending a degron to a sequence confers degradation upon the sequence. In some embodiments, the degron may be appended to the destabilizing domains, the payload or both. Incorporation of the degron within the effector module of the invention, confers additional protein instability to the effector module and may be used to minimize basal expression. In some embodiments, the degron may be an N-degron, a phospho degron, a heat inducible degron, a photosensitive degron, an oxygen dependent degron. As a non-limiting example, the degron may be an Ornithine decarboxylase degron as described by Takeuchi et al. (Takeuchi J et al. (2008). Biochem J. 2008 Mar. 1; 410(2):401-7; the contents of which are incorporated by reference in their entirety). Other examples of degrons useful in the present invention include degrons described in International patent publication Nos. WO2017004022, WO2016210343, and WO2011062962; the contents of each of which are incorporated by reference in their entirety.

In some embodiments, more than one biocircuit system may be used in combination to control various protein functions in the same cell or organism, each of which uses different DD and ligand pair and can be regulated separately.

Figure 2:
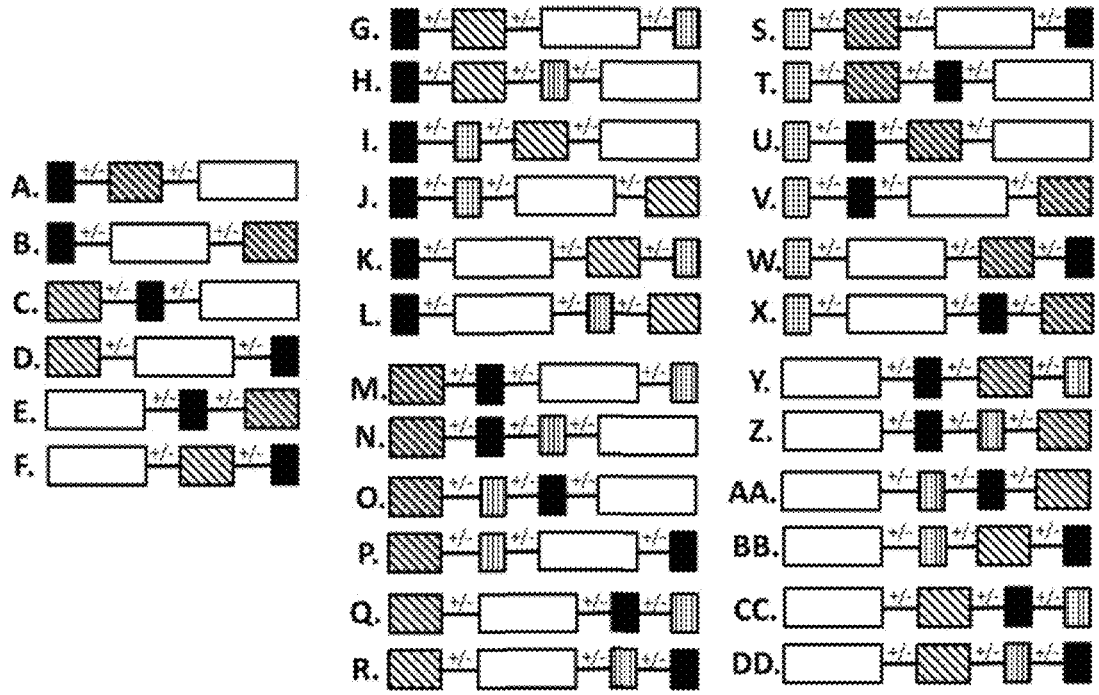
FIG. 2 shows representative effector modules carrying one payload. The signal sequence (SS), SRE and payload may be located or positioned in various arrangements without (A to F) or with (G to Z, and AA to DD) a cleavage site. An optional linker may be inserted between each component of the effector module.

As shown in FIG. 2, representative effector module embodiments comprising one payload, i.e. one immuno-therapeutic agent are illustrated. Each components of the effector module may be located or positioned in various arrangements without (A to F) or with (G to Z, and AA to DD) a cleavage site. An optional linker may be inserted between each component of the effector module.

Figure 3:
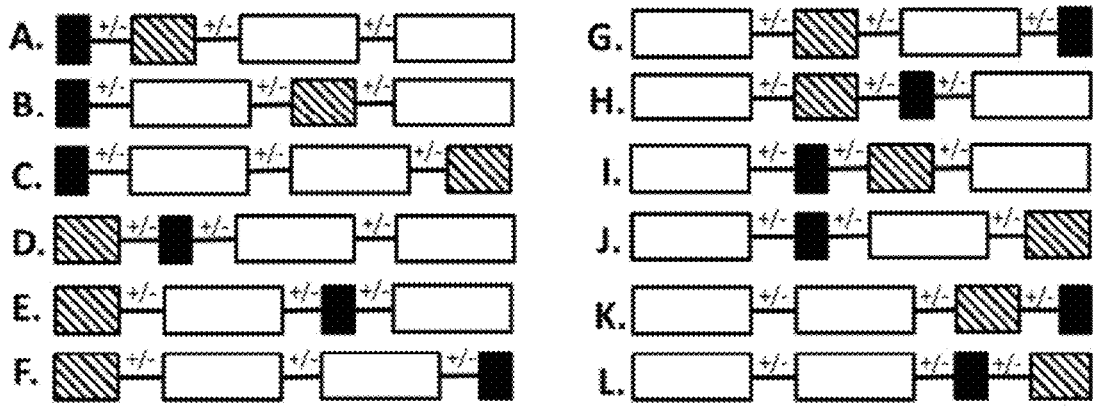
FIG. 3 shows representative effector modules carrying two payloads without a cleavage site. The two payloads may be either directly linked to each other or separated.
Figure 4:
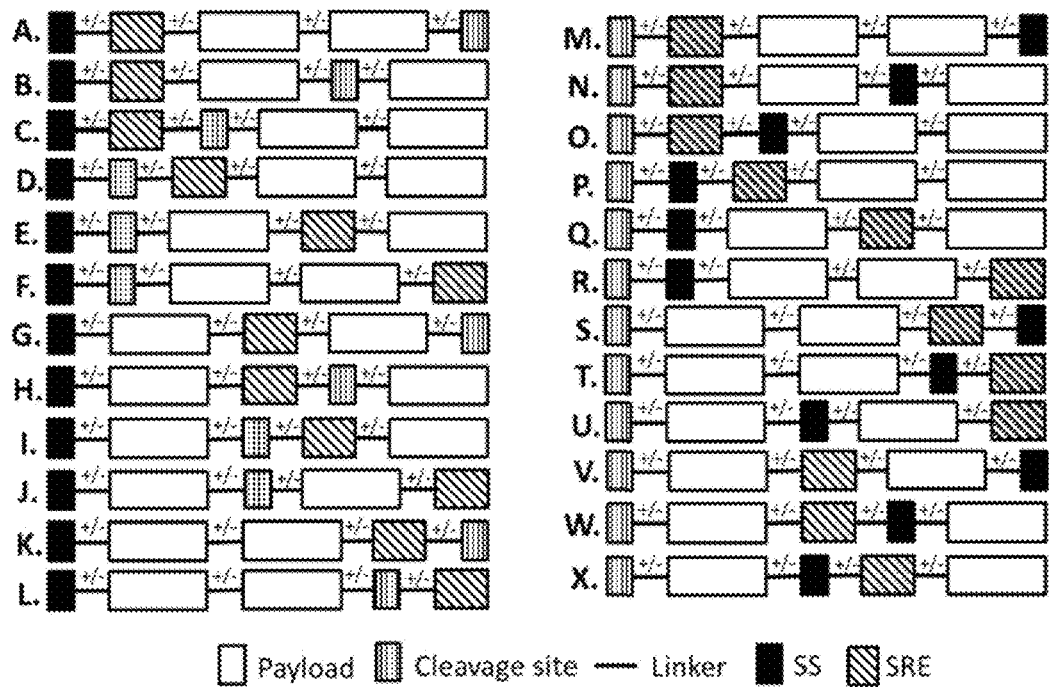
FIG. 4 shows representative effector modules carrying two payloads with a cleavage site. In one embodiment, an SS is positioned at the N-terminus of the construct, while other components: SRE, two payloads and the cleavage site may be located at different positions (A to L). In another embodiment, the cleavage site is positioned at the N-terminus of the construct (M to X). An optional linker may be inserted between each component of the effector module.
Figure 5:
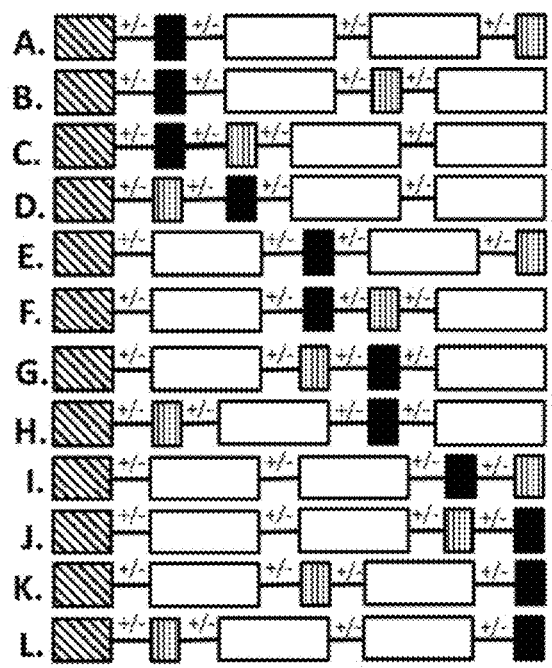
FIG. 5 shows effector modules of the invention carrying two payloads, where an SRE is positioned at the N-terminus of the construct (A to L), while SS, two payloads and the cleavage site can be in any configuration. An optional linker may be inserted between each component of the effector module.
Figure 6:
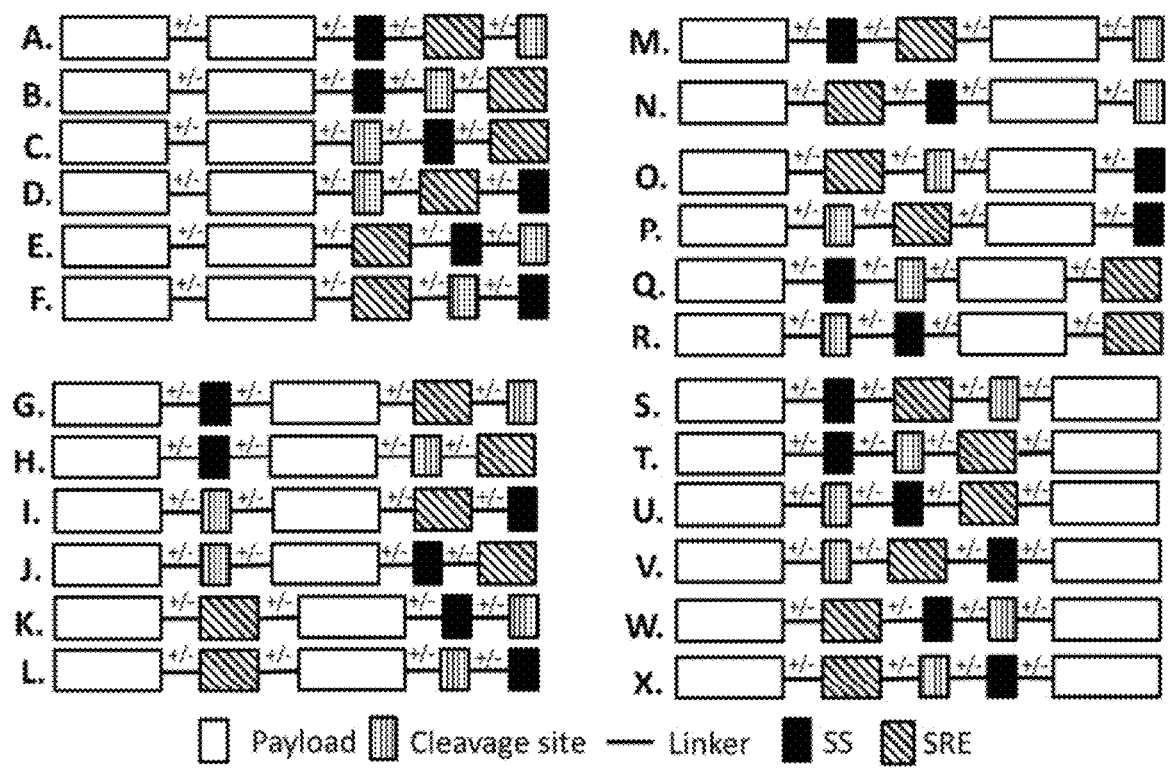
FIG. 6 shows effector modules of the invention carrying two payloads, where either the two payloads (A to F) or one of the two payloads (G to X) is positioned at the N-terminus of the construct (A to L), while SS, SRE and the cleavage site can be in any configuration. An optional linker may be inserted between each component of the effector module.
Figure 7A:
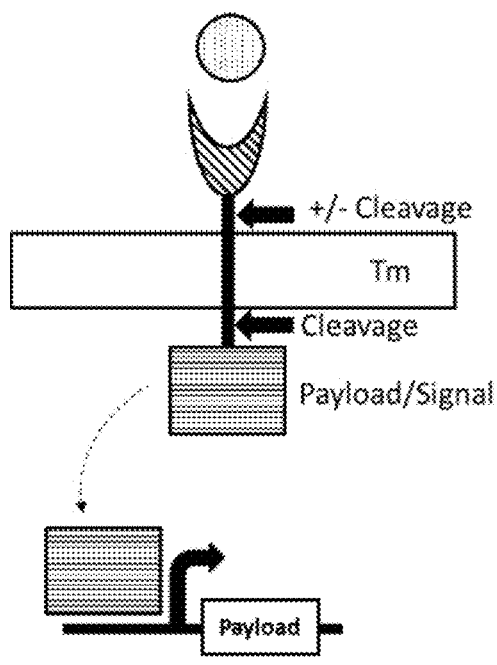
FIG. 7A-FIG. 7B depict[[s]] representative configurations of the stimulus and effector module within a biocircuit system.
Figure 7B:
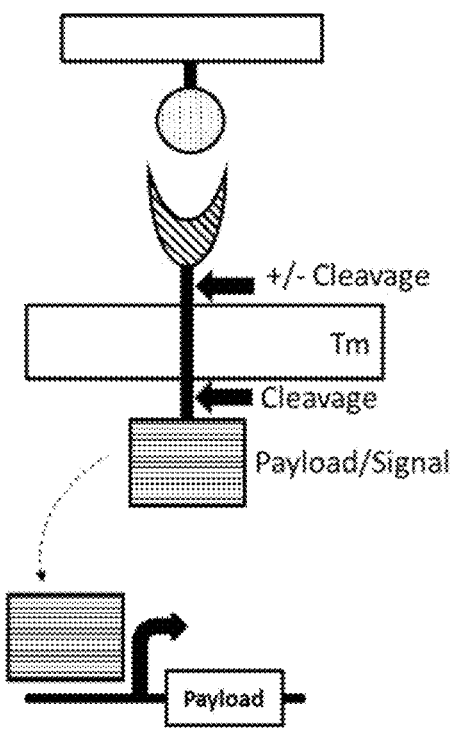
Figure 8:
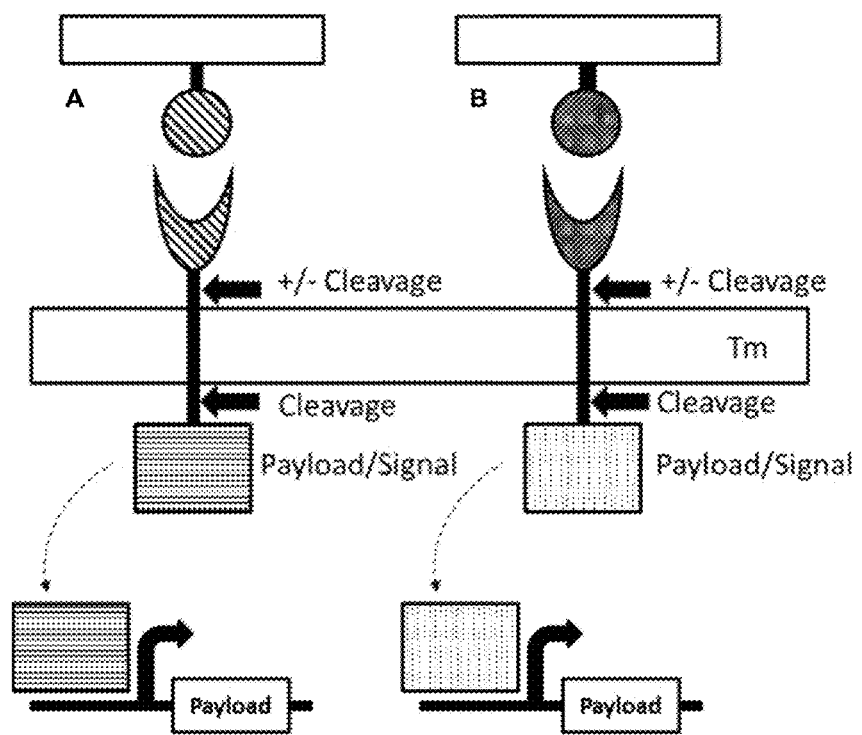
FIG. 8 depicts a dual stimulus-dual presenter biocircuit system, where two bound stimuli (A and B) from two different presenters (e.g., different cells) bind to two different effector modules in a single receiver (e.g., another single cell) simultaneously and create a dual-signal to downstream payloads.
Figure 9:
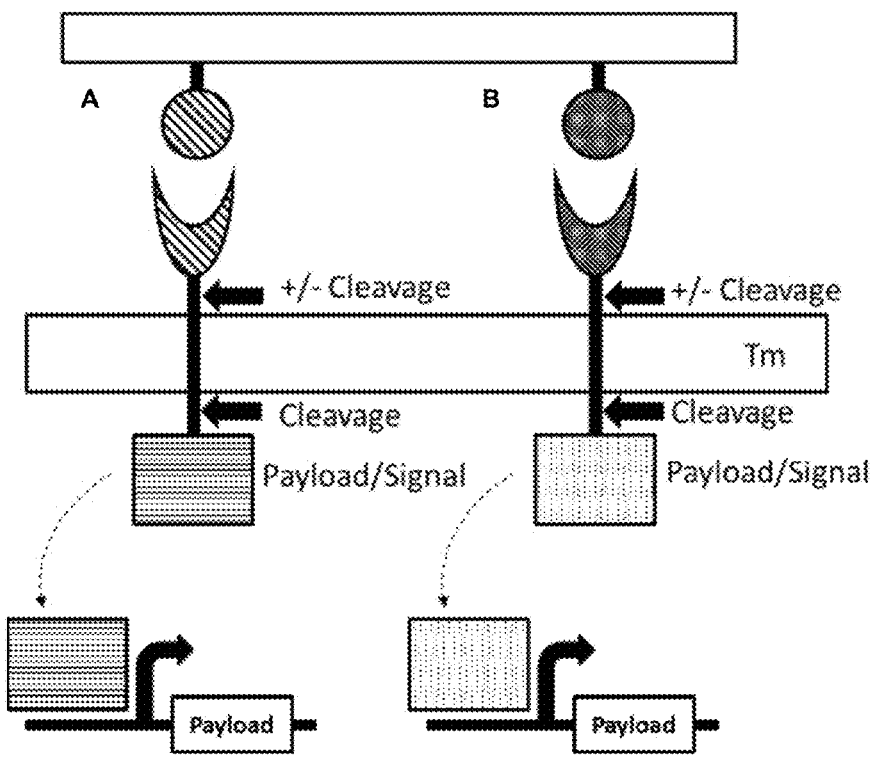
FIG. 9 depicts a dual stimulus-single presenter biocircuit system, where two bound stimuli (A and B) from the same presenter (e.g., a single cell) bind to two different effector modules in another single cell simultaneously and create a dual-signal.
Figure 10:
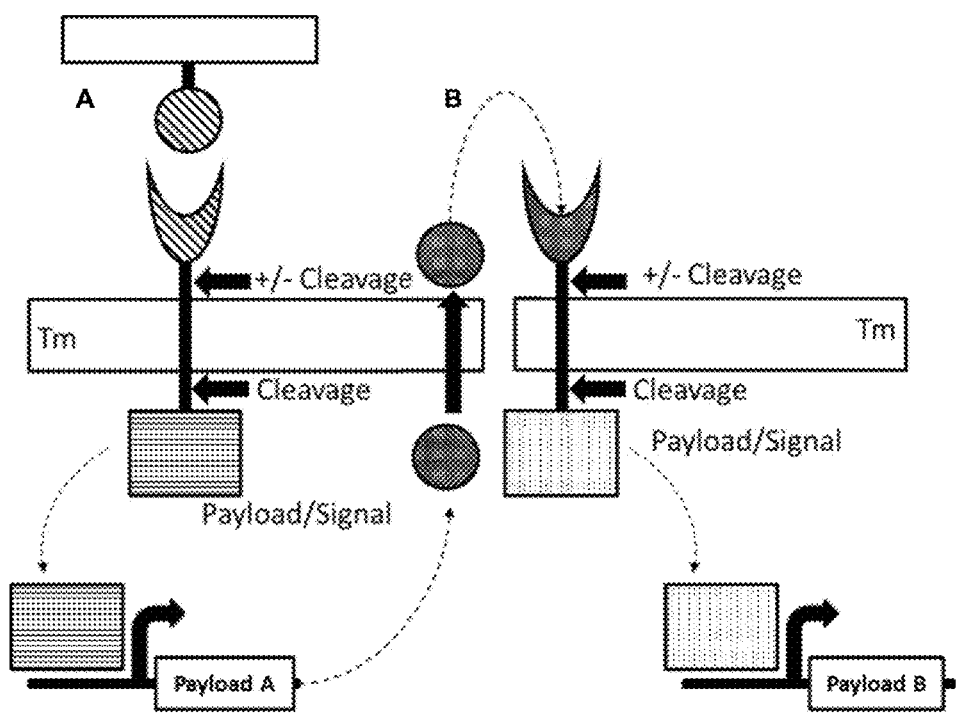
FIG. 10 depicts a single-stimulus-bridged receiver biocircuit system. In this configuration, a bound stimulus (A) binds to an effector module in the bridge cell and creates a signal to activate a payload which is a stimulus (B) for another effector module in the final receiver (e.g., another cell).
Figure 11:
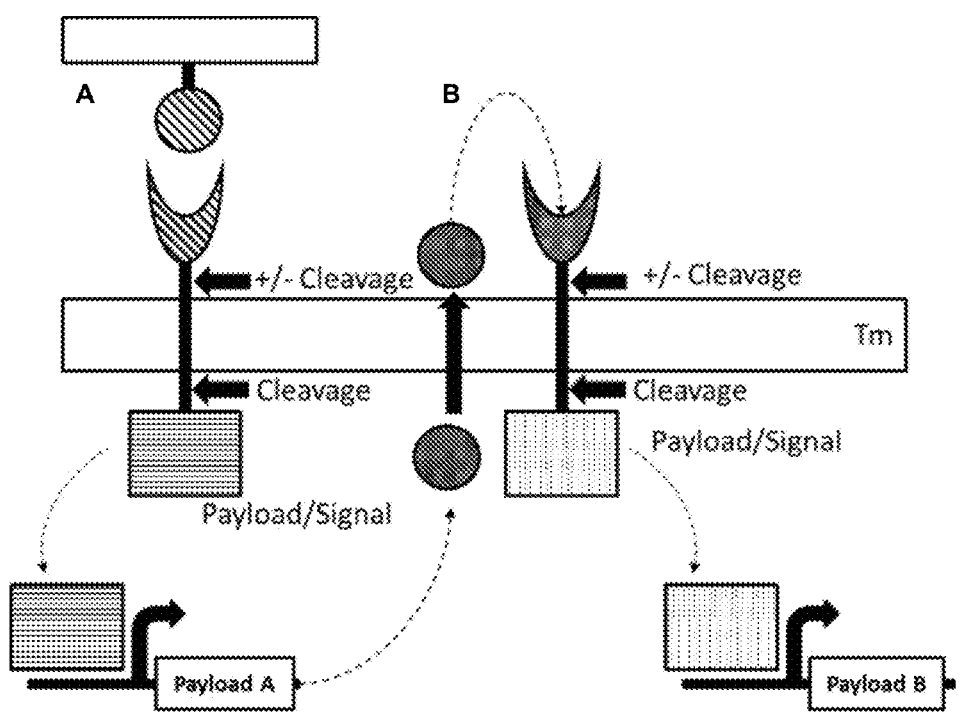
FIG. 11 depicts a single stimulus-single receiver biocircuit system, wherein the single receiver contains the two effector modules which are sequentially activated by a single stimulus.
Figure 12:
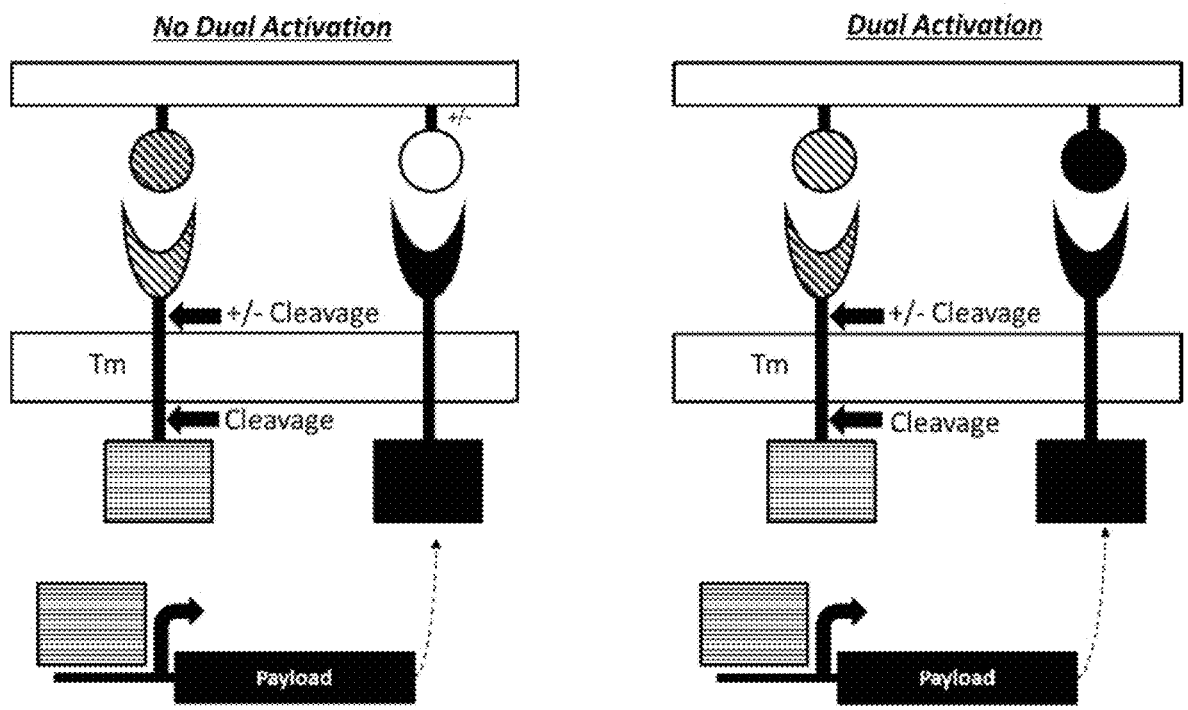
FIG. 12 depicts a biocircuit system which requires a dual activation. In this embodiment, one stimulus must bind the transmembrane effector module first to prime the receiver cell being activated by the other stimulus. The receiver only activates when it senses both stimuli.
Figure 13:
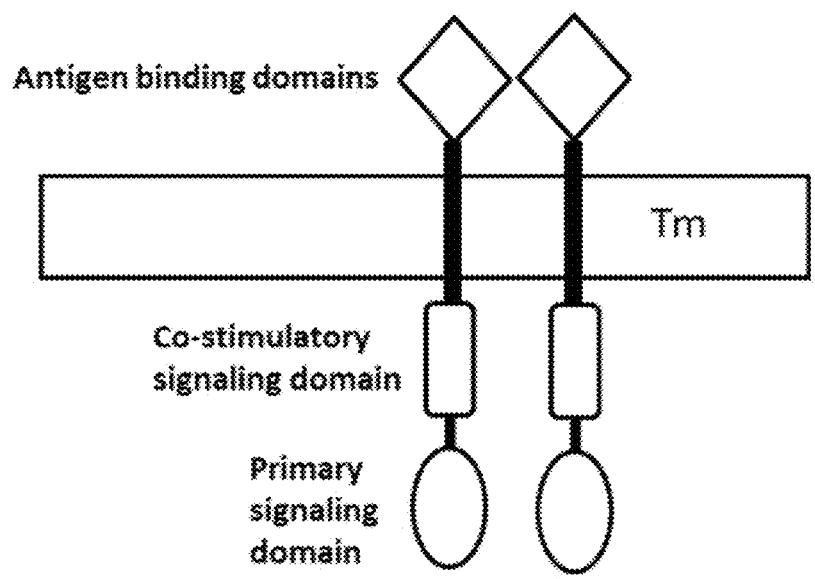
FIG. 13 depicts a standard effector module of a chimeric antigen receptor (CAR) system which comprises an antigen binding domain as an SRE, and signaling domain(s) as payload.
Figure 14:
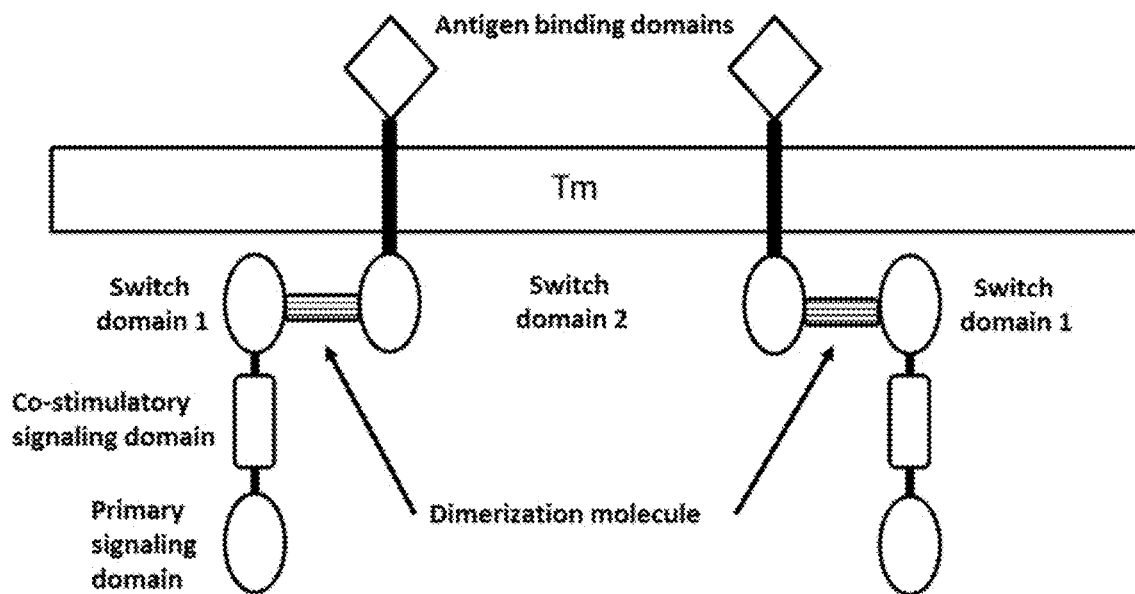
FIG. 14 depicts the structure design of a regulatable CAR system, where the trans-membrane effector modules comprise antigen binding domains sensing an antigen and a first switch domain and the intracellular module comprises a second switch domain and signaling domains. A stimulus (e.g., a dimerization small molecule) can dimerize the first and second switch domains and assemble an activated CAR system.
Figure 15A:
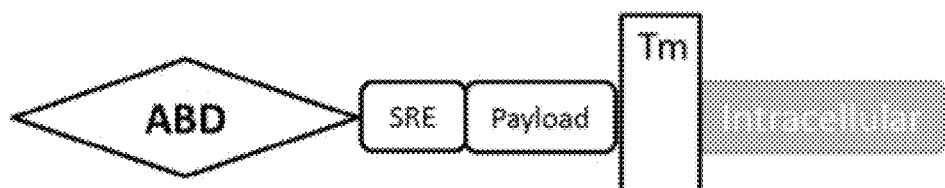
FIG. 15A-FIG. 15C show[[s]] schematic representations of CAR systems having one (FIG. 15A) or two (FIG. 15B and FIG. 15C) SREs incorporated into the effector module.
Figure 15B:
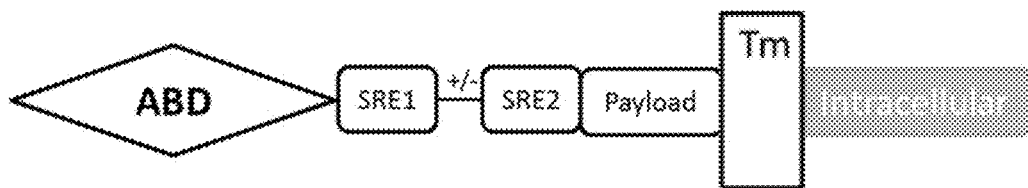
Figure 15C:
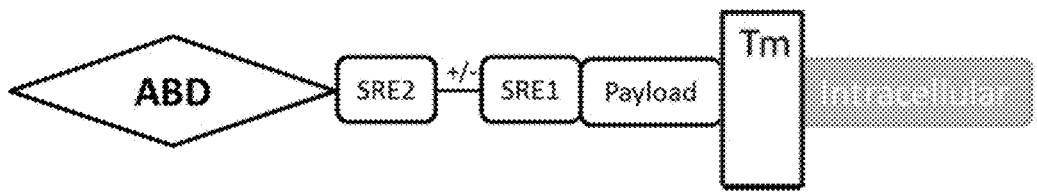
Figure 16A:
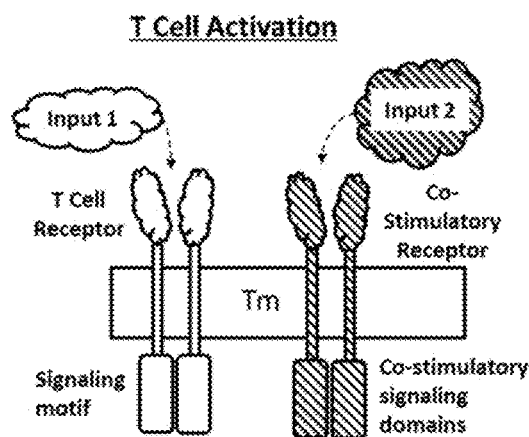
FIG. 16A-FIG. 16C depict[[s]] a split CAR design to control T cell activation by a dual stimulus (e.g., an antigen and small molecule).
Figure 16B:
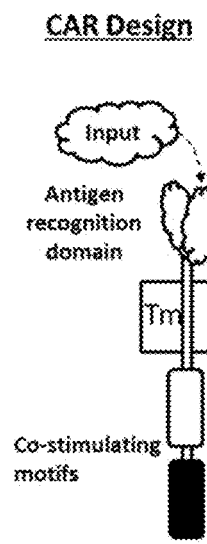
Figure 16C:
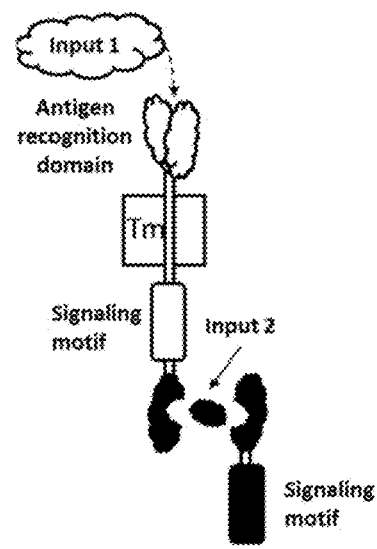
Figure 17A:
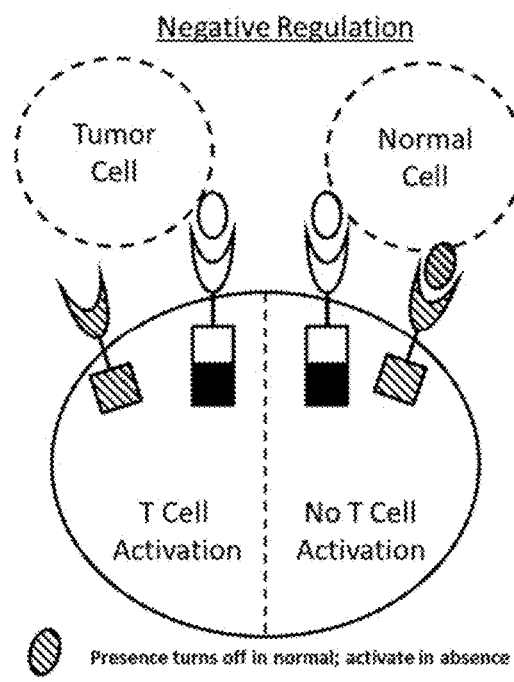
FIG. 17A-FIG. 17B depict[[s]] the positive and negative regulation of CAR engineered T cell activation. The absence or presence of a second stimulus can negatively (FIG. 17A) or positively (FIG. 17B) control T cell activation.
Figure 17B:
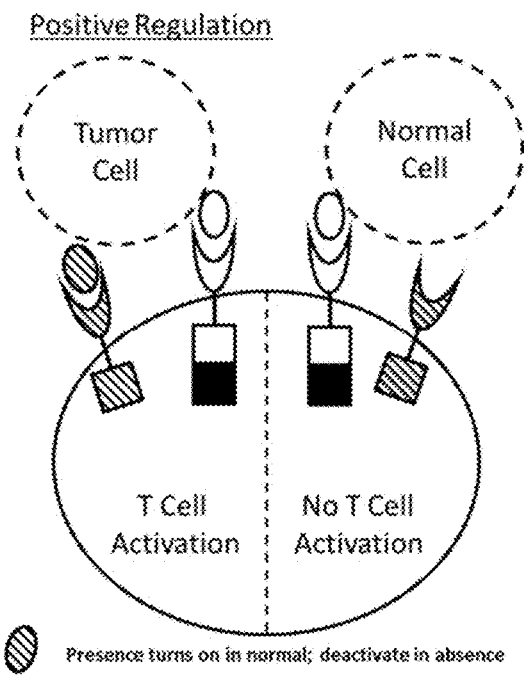
Figure 18A:
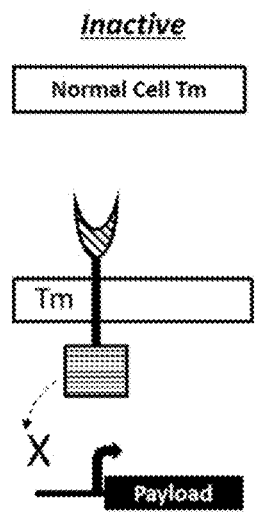
FIG. 18A-FIG. 18D show[[s]] schematic representations of gated activation of CAR engineered T cells.
Figure 18B:
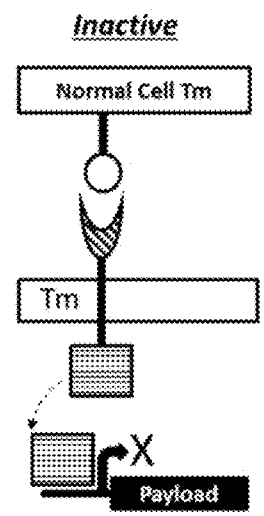
Figure 18C:
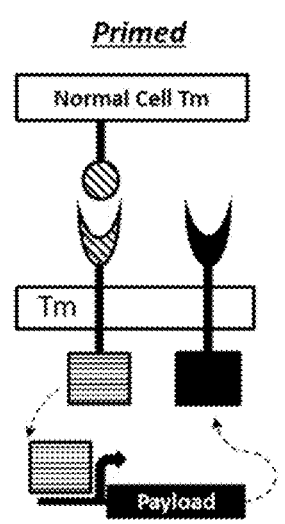
Figure 18D:
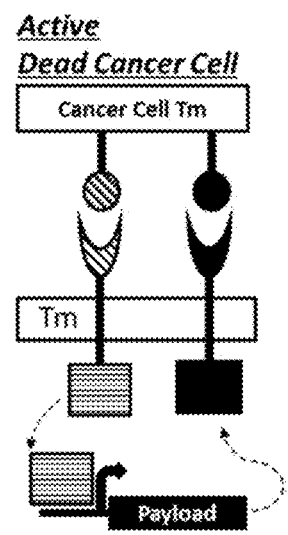
Figure 19A:
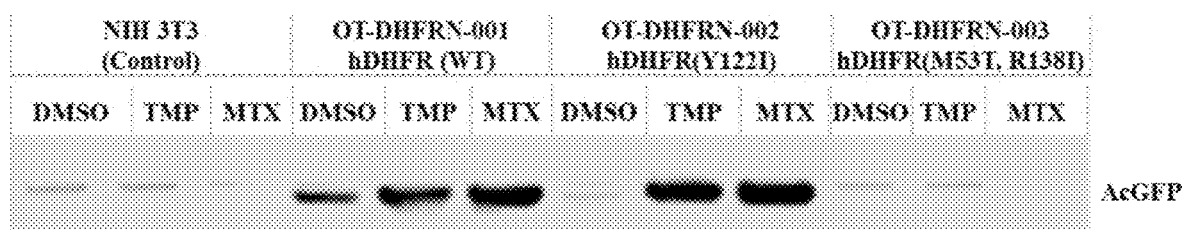
FIG. 19A-FIG. 19F show hDHFR mutants' expression in a western blot using Anti-AcGFP antibody (FIG. 19A-FIG. 19C) or anti-human DHFR antibody (FIG. 19D-FIG. 19F).
Figure 19B:
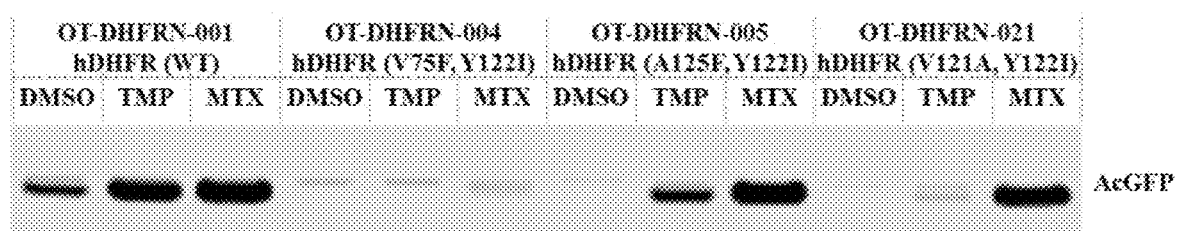
Figure 19C:
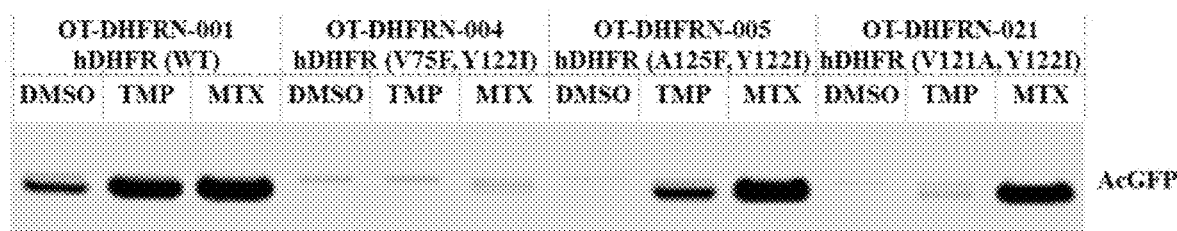
Figure 19D:
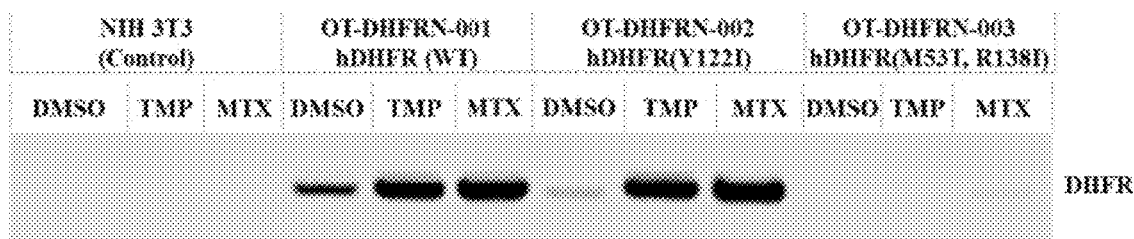
Figure 19E:
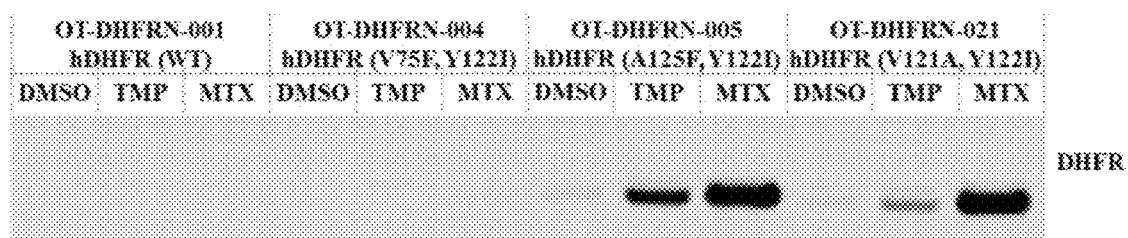
Figure 19F:
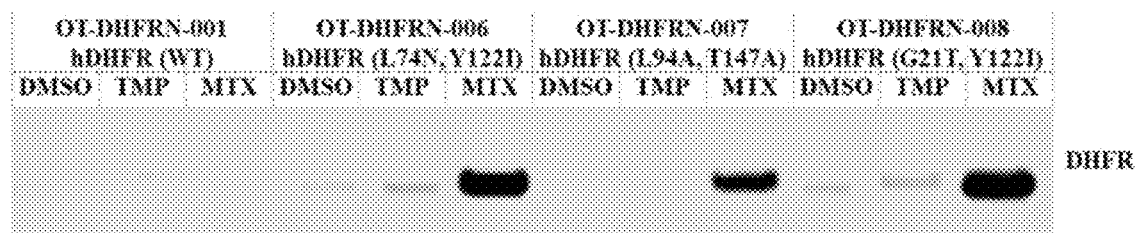

FIG. 3-FIG. 6 illustrate representative effector module embodiments comprising two payloads, i.e. two immunotherapeutic agents. In some aspects, more than two immunotherapeutic agents (payloads) may be included in the effector module under the regulation of the same SRE (e.g., the same DD). The two or more agents may be either directly linked to each other or separated (FIG. 3). The SRE may be positioned at the N-terminus of the construct, or the C-terminus of the construct, or in the internal location.

In some aspects, the two or more immunotherapeutic agents may be as represented in given in FIG. 7-FIG. 12.

In some aspects, the two or more immunotherapeutic agents may be the same type. Biocircuits and components utilizing such effector molecules are given in FIG. 7-FIG. 12.

In some aspects, the two or more immunotherapeutic agents may be the same type such as two antibodies, or different types such as a CAR construct and a cytokine IL12. Biocircuits and components utilizing such effector molecules are given in FIG. 7-FIG. 12.

In some embodiments, biocircuits of the invention may be modified to reduce their immunogenicity. Immunogenicity is the result of a complex series of responses to a substance that is perceived as foreign and may include the production of neutralizing and non-neutralizing antibodies, formation of immune complexes, complement activation, mast cell activation, inflammation, hypersensitivity responses, and anaphylaxis. Several factors can contribute to protein immunogenicity, including, but not limited to protein sequence, route and frequency of administration and patient population. In a preferred embodiment, protein engineering may be used to reduce the immunogenicity of the compositions of the invention. In some embodiments, modifications to reduce immunogenicity may include modifications that reduce binding of the processed peptides derived from the parent sequence to MHC proteins. For example, amino acid modifications may be engineered such that there are no or a minimal of number of immune epitopes that are predicted to bind with high affinity, to any prevalent MHC alleles. Several methods of identifying MHC binding epitopes of known protein sequences are known in the art and may be used to score epitopes in the compositions of the present invention. Such methods are disclosed in US Patent Publication No. US 20020119492, US20040230380, and US 20060148009; the contents of each of which are incorporated by reference in their entirety.

In some embodiments, biocircuits of the invention may be modified to reduce their immunogenicity. Immunogenicity is the result of a complex series of responses to a substance that is perceived as foreign and may include the production of neutralizing and non-neutralizing antibodies, formation of immune complexes, complement activation, mast cell activation, inflammation, hypersensitivity responses, and anaphylaxis. Several factors can contribute to protein immunogenicity, including, but not limited to protein sequence, route and frequency of administration and patient population. In a preferred embodiment, compositions of the invention may be engineered to reduce the immunogenicity of the compositions of the invention. In some embodiments, modifications to reduce immunogenicity may include modifications that reduce binding of the processed peptides derived from the parent sequence to major histocompatibility complex (MHC) proteins. For example, amino acid modifications may be engineered such that the minimum number of immune epitopes are available to bind with high affinity to any prevalent MHC alleles. Several methods of identifying MHC binding epitopes of known protein sequences are known in the art and may be useful in the present invention. Such methods are disclosed in US Patent Publication No. US 20020119492, US20040230380, and US 20060148009; the contents of each of which are incorporated by reference in their entirety.

Epitope identification and subsequent sequence modification may be applied to reduce immunogenicity. The identification of immunogenic epitopes may be achieved either physically or computationally. Physical methods of epitope identification may include, for example, mass spectrometry and tissue culture/cellular techniques. Computational approaches that utilize information obtained on antigen processing, loading and display, structural and/or proteomic data toward identifying non-self-peptides that may result from antigen processing, and that are likely to have good binding characteristics in the groove of the MHC may also be utilized. One or more mutations may be introduced into the biocircuits of the invention directing the expression of the protein, to maintain its functionality while simultaneously rendering the identified epitope less or non-immunogenic.

In some embodiments, the endoplasmic reticulum associated degradation (ERAD) pathway may be used to optimize degradation of the payloads described herein e.g. secreted and membrane cargos. In one embodiment, the effector modules of the invention may directed to the ER E3 ligases by using adaptor proteins or protein domains. The endoplasmic reticulum is endowed with a specialized machinery to ensure proteins deployed to the distal secretory pathway are correctly folded and assembled into native oligomeric complexes. Proteins failing to meet this conformational standard are degraded by the ERAD pathway, a process through which folding defective proteins are selected and ultimately degraded by the ubiquitin proteasome system. ERAD proceeds through four main steps involving substrate selection, dislocation across the ER membrane, covalent conjugation with polyubiquitin, and proteasome degradation. Any of these steps may be modulated to optimize the degradation of the payloads and the effector modules described herein. Protein adaptors within the ER membrane, link substrate recognition to the ERAD machinery (herein referred to as the "dislocon"), which causes the dislocation of the proteins from the ER. Non-limiting examples of protein adaptors that may be used to optimize ERAD pathway degradation include, but are not limited to SEL1L (an adaptor that links glycan recognition to the dislocon), Erlins (intermembrane substrate adaptors), Insigs (client specific adaptors), F-Box proteins (act as adaptors for dislocated glycoproteins in the cytoplasm) and viral-encoded adaptors.

In some embodiments, protein modifications engineered into the structure of the compositions of the invention to interfere with antigen processing and peptide loading such as glycosylation and PEGylation, may also be useful in the present invention. Compositions of the invention may also be engineered to include non-classical amino acid sidechains to design less immunogenic compositions. Any of the methods discussed in International Patent Publication No. WO2005051975 for reducing immunogenicity may be useful in the present invention (the contents of which are incorporated by reference in their entirety).

In one embodiment, patients may also be stratified according to the immunogenic peptides presented by their immune cells and may be utilized as a parameter to determine suitable patient cohorts that may therapeutically benefit for the compositions of the invention.

In some embodiments, reduced immunogenicity may be achieved by limiting immunoproteasome processing. The proteasome is an important cellular protease that is found in two forms: the constitutive proteasome, which is expressed in all cell types and which contains active e.g. catalytic subunits and the immunoproteasome that is expressed in cell of the hematopoietic lineage, and which contains different active subunits termed low molecular weight proteins (LMP) namely LMP-2, LMP-7 and LMP-10. Immunoproteasomes exhibit altered peptidase activities and cleavage site preferences that result in more efficient liberation of many MHC class I epitopes. A well described function of the immunoproteasome is to generate peptides with hydrophobic C terminus that can be processed to fit in the groove of MHC class I molecules. Deol P et al. have shown that immunoproteasomes may lead to a frequent cleavage of specific peptide bonds and thereby to a faster appearance of a certain peptide on the surface of the antigen presenting cells; and enhanced peptide quantities (Deol P et al. (2007) J Immunol 178 (12) 7557-7562; the contents of which are incorporated herein reference in its entirety). This study indicates that reduced immunoproteasome processing may be accompanied by reduced immunogenicity. In some embodiments, immunogenicity of the compositions of the invention may be reduced by modifying the sequence encoding the compositions of the invention to prevent immunoproteasome processing. Biocircuits of the present invention may also be combined with immunoproteasome-selective inhibitors to achieve the same effects. Examples of inhibitors useful in the present invention include UK-101 (B1i selective compound), IPSI-001, ONX 0914 (PR-957), and PR-924 (IPSI).

Another embodiment of the invention provides a method of detecting the presence of cancer in a mammal, comprising: (a) contacting a sample comprising one or more cells from the mammal with any of the CARs, nucleic acids, recombinant expression vectors, host cells, population of cells, or pharmaceutical compositions of the invention, thereby forming a complex, (b) and detecting the complex, wherein detection of the complex is indicative of the presence of cancer in the mammal. The sample may be obtained by any suitable method, e.g., biopsy or necropsy. A biopsy is the removal of tissue and/or cells from an individual. Such removal may be to collect tissue and/or cells from the individual in order to perform experimentation on the removed tissue and/or cells. This experimentation may also be used to determine if the individual has and/or is suffering from cancer.

With respect to an embodiment of the inventive method of detecting the presence of cancer in a mammal, the sample comprising cells of the mammal can be a sample comprising whole cells, lysates thereof, or a fraction of the whole cell lysates, e.g., a nuclear or cytoplasmic fraction, a whole protein traction, or a nucleic acid fraction. If the sample comprises whole cells, the cells can be any cells of the mammal, e.g., the cells of any organ or tissue, including tumor cells. The contacting can take place in vitro or in vivo with respect, to the mammal. Preferably, the contacting is in vitro. Also, detection of the complex can occur through any number of ways known in the art. For instance, the inventive CARs, nucleic acids, recombinant expression vectors, host cells, populations of cells, or pharmaceutical compositions described herein can be labeled with a detectable label such as, for instance, a radioisotope, a fluorophore (e.g., fluorescein isothiocyanate (FITC), phycoerythrin (PE)), an enzyme (e.g., alkaline phosphatase, horseradish peroxidase), and element particles (e.g., gold particles). Methods of testing the compositions of the invention for the ability to recognize target cells and for antigen specificity are known in the art. For instance, Clay et al, J. Immunol, 163: 507-51 3 (1999), teaches methods of measuring the release of cytokines (e.g., interferon-γ, granulocyte/monocyte colony stimulating factor (GM-CSF), tumor necrosis factor a (TNF-a) or interleukin 2 (IL2)). In addition, anti-CD276 material function can be evaluated by measurement of cellular cytotoxicity, as described in Zhao et al., J. Immunol, 1 74: 44) 5-4423 (2005).

In some embodiments, the stimulus of the present invention maybe ultrasound stimulation. In some embodiments, the SREs of the present invention may derived from mechanosensitive proteins. In one embodiment, the SRE of the present invention may be the mechanically sensitive ion channel, Piezo1.

Expression of the payload of interest in such instances is tuned by providing focused ultrasound stimulation. In other embodiments, the SREs of the present invention may be derived from calcium biosensors, and the stimulus of the present invention may calcium. The calcium may be generated by the ultrasound induced mechanical stimulation of mechanosensitive ion channels. The ultrasound activation of the ion channel causes a calcium influx thereby generating the stimulus. In one embodiment, the mechanosensitive ion channel is Piezo 1. Mechanosensors may be advantageous to use since they provide spatial control to a specific location in the body.

Destabilizing Domains (DDs)

As used herein, the term "destabilizing domains (DDs)" refers to protein domains that are unstable and degraded in the absence of ligand, but whose stability is rescued by binding to a high affinity cell-permeable ligand. Destabilizing domains (DDs) can be appended to a target protein of interest (POI) and can convey its destabilizing property to the protein of interest, causing protein degradation. The presence, absence or an amount of a small molecule ligand that binds to or interacts with the DD, can, upon such binding or interaction modulate the stability of the payload(s) and consequently the function of the payload. A protein domain with destabilizing property (e.g. a DD) is used in conjunction with a cell-permeable ligand to regulate any protein of interest when it is fused with the destabilizing domain. DDs render the attached protein of interest unstable in the absence of a DD-binding ligand such that the protein is rapidly degraded by the ubiquitin-proteasome system of the cell. However, when a specific small molecule ligand binds its intended DD as a ligand binding partner, the instability is reversed and protein function is restored. The conditional nature of DD stability allows a rapid and non-perturbing switch from stable protein to unstable substrate for degradation. Moreover, its dependency on the concentration of its ligand further provides tunable control of degradation rates. Depending on the degree of binding and/or interaction the altered function of the payload may vary, hence providing a "tuning" of the payload function.

Due to its reversibility, specificity and the fast and easy regulation on protein level, the post-transcriptional tuning system provides a useful system for gene regulation. Furthermore, the regulation may be dose-dependent, thereby altering the protein-turnover rate to transform a short-lived or no detectable protein into a protein that functions for a precisely controlled period of time (Iwamoto et al., *Chem. Biol.* 2010, 17: 981-988).

In some embodiments, the desired characteristics of the DDs may include, but are not limited to, low protein levels in the absence of a ligand of the DD (i.e. low basal stability), large dynamic range, robust and predictable dose-response behavior, and rapid kinetics of degradation. Candidate DDs that bind to a desired ligand but not endogenous molecules may be preferred.

Candidate destabilizing domain sequence identified from protein domains of known wildtype proteins (as a template) may be mutated to generate libraries of mutants based on the template candidate domain sequence. Mutagenesis strategies used to generate DD libraries may include site-directed mutagenesis e.g. by using structure guided information, or random mutagenesis e.g. using error-prone PCR, or a combination of both. In some embodiments, destabilizing domains identified using random mutagenesis may be used to identify structural properties of the candidate DDs that may be required for destabilization, which may then be used to further generate libraries of mutations using site directed mutagenesis.

In some embodiments, novel DDs may be identified by mutating one or more amino acids in the candidate destabilizing domain to an amino acid that is vicinal to the mutation site. As used herein a vicinal amino acid refers to an amino acid that is located 1, 2, 3, 4, 5 or more amino acids upstream or downstream of the mutation site in the linear sequence and/or the crystal structure of the candidate destabilizing domain. In some embodiments, the vicinal amino acid may be a conserved amino acid (with similar physicochemical properties as the amino acid at the mutation site), a semi conserved amino acid (e.g. negatively to positively charge amino acid) or a non-conserved amino acid (with different physicochemical properties than the amino acid at the mutation site).

In some embodiments, DD mutant libraries may be screened for mutations with altered, preferably higher binding affinity to the ligand, as compared to the wild type protein. DD libraries may also be screened using two or more ligands and DD mutations that are stabilized by some ligands but not others may be preferentially selected. DD mutations that bind preferentially to the ligand compared to a naturally occurring protein may also be selected. Such methods may be used to optimize ligand selection and ligand binding affinity of the DD. Additionally, such approaches can be used to minimize deleterious effects caused by off-target ligand binding.

In some embodiments, suitable DDs may be identified by screening mutant libraries using barcodes. Such methods may be used to detect, identify and quantify individual mutant clones within the heterogeneous mutant library. Each DD mutant within the library may have distinct barcode sequences (with respect to each other). In other instances, the polynucleotides can also have different barcode sequences with respect to 2, 3, 4, 5, 6, 7, 8, 9, 10 or more nucleic acid bases. Each DD mutant within the library may also comprise a plurality of barcode sequences. When used in plurality barcodes may be used such that each barcode is unique to any other barcode. Alternatively, each barcode used may not be unique, but the combination of barcodes used may create a unique sequence that can be individually tracked. The barcode sequence may be placed upstream of the SRE, downstream of the SRE, or in some instances may be placed within the SRE. DD mutants may be identified by barcodes using sequencing approaches such as Sanger sequencing, and next generation sequencing, but also by polymerase chain reaction and quantitative polymerase chain reaction. In some embodiments, polymerase chain reaction primers that amplify a different size product for each barcode may be used to identify each barcode on an agarose gel. In other instances, each barcode may have a unique quantitative polymerase chain reaction probe sequence that enables targeted amplification of each barcode.

Inventors of the present invention investigated several human proteins and identified novel human DDs which can confer its instability features to the fused payload and facilitate the rapid degradation of the fusion polypeptide in the absence of its ligand but stabilize the fused payload in response to the binding to its ligand. Specifically, the new DDs are derived from human DHFR protein (hDHFR).

In some embodiments, biocircuit systems, effector modules, and compositions of the present invention relate to post-translational regulation of protein (payload) function anti-tumor immune responses of immunotherapeutic agents. In one embodiment, the SRE is a stabilizing/destabilizing domain (DD). The presence, absence or an amount of a small molecule ligand that binds to or interacts with the DD, can, upon such binding or interaction modulate the stability of the payload(s) and consequently the function of the payload. Depending on the degree of binding and/or interaction the altered function of the payload may vary, hence providing a "tuning" of the payload function.

In some embodiments, biocircuit systems, effector modules, and compositions of the present invention relate to post-translational regulation of protein (payload) function, in particular, anti-tumor immune responses of immunotherapeutic agents. In one embodiment, the SRE is a stabilizing/destabilizing domain (DD). The presence, absence or an amount of a small molecule ligand that binds to or interacts with the DD, can, upon such binding or interaction modulate the stability of the payload(s) and consequently the function of the payload. Depending on the degree of binding and/or interaction the altered function of the payload may vary, hence providing a "tuning" of the payload function.

In some embodiments, destabilizing domains described herein or known in the art may be used as SREs in the biocircuit systems of the present invention in association with any of the immunotherapeutic agents (payloads) taught herein. Destabilizing domains (DDs) are small protein domains that can be appended to a target protein of interest. DDs render the attached protein of interest unstable in the absence of a DD-binding ligand such that the protein is rapidly degraded by the ubiquitin-proteasome system of the cell (Stankunas, K., et al., Mol. Cell, 2003, 12: 1615-1624; Banaszynski, et al., Cell; 2006, 126(5): 995-1004; reviewed in Banaszynski, L. A., and Wandless, T. J. *Chem. Biol.*; 2006, 13:11-21 and Rakhit R et al., *Chem Biol.* 2014; 21(9): 1238-1252). However, when a specific small molecule ligand binds its intended DD as a ligand binding partner, the instability is reversed and protein function is restored. The conditional nature of DD stability allows a rapid and non-perturbing switch from stable protein to unstable substrate for degradation. Moreover, its dependency on the concentration of its ligand further provides tunable control of degradation rates.

In some embodiments, the desired characteristics of the DDs may include, but are not limited to, low protein levels in the absence of a ligand of the DD (i.e. low basal stability), large dynamic range, robust and predictable dose-response behavior, and rapid kinetics of degradation. DDs that bind to a desired ligand but not endogenous molecules may be preferred.

Several protein domains with destabilizing properties and their paired small molecules have been identified and used to control protein expression, including FKBP/shield-1 system (Egeler et al., *J Biol. Chem.* 2011, 286(36): 32328-31336; the contents of which are incorporated herein by reference in their entirety), ecDHFR and its ligand trimethoprim (TMP); estrogen receptor domains which can be regulated by several estrogen receptor antagonists (Miyazaki et al., *J Am Chem. Soc.*, 2012, 134(9): 3942-3945; the contents of which are incorporated by reference herein in their entirety); and fluorescent destabilizing domain (FDD) derived from bilirubin-inducible fluorescent protein, UnaG and its cognate ligand bilirubin (BR) (Navarro et al., *ACS Chem Biol.*, 2016, Jun. 6; the contents of which are incorporated herein by reference in their entirety).

Known DDs also include those described in U.S. Pat. Nos. 8,173,792 and 8,530,636, the contents of which are each incorporated herein by reference in their entirety.

In some embodiments, the DDs of the present invention may be derived from some known sequences that have been approved to be capable of post-translational regulation of proteins. For example, Xiong et al., have demonstrated that the non-catalytic N-terminal domain (54-residues) of ACS7 (1-aminocyclopropane-1-carboxylate synthase) in *Arabidopsis*, when fused to the β-glucuronidase (GUS) reporter, can significantly decrease the accumulation of the GUS fusion protein (Xiong et al., *J. Exp. Bot.*, 2014, 65(15): 4397-4408). Xiong et al. further demonstrated that both exogenous 1-aminocyclopropane-1-carboxylic acid (ACC) treatment and salt can rescue the levels of accumulation of the ACS N-terminal and GUS fusion protein. The ACS N-terminus mediates the regulation of ACS7 stability through the ubiquitin-26S proteasome pathway.

Another non-limiting example is the stability control region (SCR, residues 97-118) of Tropomyosin (Tm), which controls protein stability. A destabilizing mutation L110A, and a stabilizing mutation A109L dramatically affect Tropomyosin protein dynamics (Kirwan and Hodges, *J Biol. Chem.*, 2014, 289: 4356-4366). Such sequences can be screened for ligands that bind them and regulate their stability. The identified sequence and ligand pairs may be used as components of the present invention.

In some embodiments, the DDs of the present invention may be developed from known proteins. Regions or portions or domains of wild type proteins may be utilized as SREs/DDs in whole or in part. They may be combined or rearranged to create new peptides, proteins, regions or domains of which any may be used as SREs/DDs or the starting point for the design of further SREs and/or DDs.

Ligands such as small molecules that are well known to bind candidate proteins can be tested for their regulation in protein responses. The small molecules may be clinically approved to be safe and have appropriate pharmaceutical kinetics and distribution. In some embodiments, the stimulus is a ligand of a destabilizing domain (DD), for example, a small molecule that binds a destabilizing domain and stabilizes the POI fused to the destabilizing domain. In some embodiments, ligands, DDs and SREs of the present invention, include without limitation, any of those taught in Tables 2-4 of copending commonly owned U.S. Provisional Patent Application No. 62/320,864 filed on Apr. 11, 2016, or in U.S. Provisional Application No. 62/466,596 filed Mar. 3, 2017 and the International Publication WO2017/180587, the contents of each of which are incorporated herein by reference in their entirety.

Some examples of the proteins that may be used to develop DDs and their ligands are listed in Table 1.

TABLE 1

Proteins and their binding ligands

| Protein | Protein Sequence | Protein SEQ ID NO.: | Ligands |
|---|---|---|---|
| E. coli Dihydrofolate reductase (ecDHFR) (Uniprot ID: P0ABQ4) | MISLIAALAVDRVIGMENAMPWNLPADL AWFKRNTLNKPVIMGRHTWESIGRPLPGR KNIILSSQPGTDDRVTWVKSVDEAIAACG DVPEIMVIGGGRVYEQFLPKAQKLYLTHI DAEVEGDTHFPDYEPDDWESVFSEFHDA DAQNSHSYCFEILERR | 194 | Methotrexate (MTX) Trimethoprim (TMP) |
| Human Dihydrofolate reductase (hDHFR) (Uniprot ID: P00374) | MVGSLNCIVAVSQNMGIGKNGDLPWPPL RNEFRYFQRMTTTSSVEGKQNLVIMGKK TWFSIPEKNRPLKGRINLVLSRELKEPPQG AHFLSRSLDDALKLTEQPELANKVDMVW IVGGSSVYKEAMNHPGHLKLFVTRIMQDF ESDTFFPEIDLEKYKLLPEYPGVLSDVQEE KGIKYKFEVYEKND | 193 | Methotrexate (MTX) Trimethoprim (TMP) |
| FK506 binding protein (FKBP) (Uniprot ID: P62942) | GVQVETISPGDGRTFPKRGQTCVVHYTG MLEDGKKFDSSRDRNKPFKFMLGKQEVI RGWEEGVAQMSVGQRAKLTISPDYAYGA TGHPGIIPPHATLVFDVELLKLE | 192 | Shield-1 |
| Phosphodiesterase 5 (PDE5), ligand binding domain (Uniprot ID: Uniprot ID O76074) | MEETRELQSLAAAVVPSAQTLKITDFSFS DFELSDLETALCTIRMFTDLNLVQNFQMK HEVLCRWILSVKKNYRKNVAYHNWRHA FNTAQCMFAALKAGKIQNKLTDLEILALL IAALSHDLDHRGVNNSYIQRSEHPLAQLY CHSIMEHHHFDQCLMILNSPGNQILSGLSI EEYKTTLKIIKQAILATDLALYIKRRGEFFE LIRKNQFNLEDPHQKELFLAMLMTACDLS AITKPWPIQQRIAELVATEFFDQGDRERKE LNIEPTDLMNREKKNKIPSMQVGFIDAICL QLYEALTHVSEDCFPLLDGCRKNRQKWQ ALAEQQ | 195 | Sildenafil; Vardenafil; Tadalafil |

TABLE 1-continued

Proteins and their binding ligands

| Protein | Protein Sequence | Protein SEQ ID NO.: | Ligands |
|---|---|---|---|
| PPAR gamma, ligand binding domain (Uniprot ID: P37231; amino acids 317-505) | SVEAVQEITEYAKSIPGFVNLDLNDQVTL LKYGVHEIIYTMLASLMNKDGVLISEGQG FMTREFLKSLRKPFGDFMEPKFEFAVKFN ALELDDSDLAIFIAVIILSGDRPGLLNVKPI EDIQDNLLQALELQLKLNHPESSQLFAKL LQKMTDLRQIVTEHVQLLQVIKKTETDMS LHPLLQEIYKDLY | 196 | Posiglitazone Pioglitazone |
| Carbonic anhydrase II (CA2) (Uniprot ID: P00918) | MSHHWGYGKHNGPEHWHKDFPIAKGER QSPVDIDTHTAKYDPSLKPLSVSYDQATS LRILNNGHAFNVEFDDSQDKAVLKGGPL DGTYRLIQFHFHWGSLDGQGSEHTVDKK KYAAELHLVHWNTKYGDFGKAVQQPDG LAVLGIFLKVGSAKPGLQKVVDVLDSIKT KGKSADFTNFDPRGLLPESLDYWTYPGSL TTPPLLECVTWIVLKEPISVSSEQVLKFRK LNFNGEGEPEELMVDNWRPAQPLKNRQI KASFK | 197 | Celecoxib Acetazolamide |
| NRH: Quinone oxidoreductase 2 (NQO2) (Uniprot ID: P16083) | MAGKKVLIVYAHQEPKSFNGSLKNVAVD ELSRQGCTVTVSDLYAMNLEPRATDKDIT GTLSNPEVFNYGVETHEAYKQRSLASDIT DEQKKVREADLVIFQFPLYWFSVPAILKG WMDRVLCQGFAFDIPGFYDSGLLQGKLA LLSVTTGGTAEMYTKTGVNGDSRYFLWP LQHGTLHFCGFKVLAPQISFAPEIASEEER KGMVAAWSQRLQTIWKEEPIPCTAHWHF GQ | 198 | Imatinib Melatonin |
| Dipeptidyl peptidases (DPPIV) (Uniprot ID: P27487) | MKTPWKVLLGLLGAAALVTIITVPVVLLN KGTDDATADSRKTYTLTDYLKNTYRLKL YSLRWISDHEYLYKQENNILVFNAEYGNS SVFLENSTFDEFGHSINDYSISPDGQFILLE YNYVKQWRHSYTASYDIYDLNKRQLITE ERIPNNTQWVTWSPVGHKLAYVWNNDIY VKIEPNLPSYRITWTGKEDIIYNGITDWVY EEEVFSAYSALWWSPNGTFLAYAQFNDT EVPLIEYSFYSDESLQYPKTVRVPYPKAG AVNPTVKFFVVNTDSLSSVTNATSIQITAP ASMLIGDHYLCDVTWATQERISLQWLRRI QNYSVMDICDYDESSGRWNCLVARQHIE MSTTGWVGRFRPSEPHFTLDGNSFYKIISN EEGYRHICYFQIDKKDCTFITKGTWEVIGI EALTSDYLYYISNEYKGMPGGRNLYKIQL SDYTKVTCLSCELNPERCQYYSVSFSKEA KYYQLRCSGPGLPLYTLHSSVNDKGLRVL EDNSALDKMLQNVQMPSKKLDFIILNETK FWYQMILPPHFDKSKKYPLLLDVYAGPCS QKADTVFRLNWATYLASTENIIVASFDGR GSGYQGDKIMHAINRRLGTFEVEDQIEAA RQFSKMGFVDNKRIAIWGWSYGGYVTSM VLGSGSGVFKCGIAVAPVSRWEYYDSVY TERYMGLPTPEDNLDHYRNSTVMSRAEN FKQVEYLLIHGTADDNVHFQQSAQISKAL VDVGVDFQAMWYTDEDHGIASSTAHQHI YTHMSHFIKQCFSLP | 1172 | Sitagliptin, Saxagliptin, Denagliptin |

In some embodiments, DDs of the invention may be FKBP DD or ecDHFR DDs such as those listed in Table 2. The position of the mutated amino acid listed in Table 2 is relative to the ecDHFR (Uniprot ID: P0ABQ4) of SEQ ID NO. 4219 for ecDHFR DDs and relative to FKBP (Uniprot ID: P62942) of SEQ ID NO. 4220 for FKBP DDs.

In some embodiments, DDs of the invention may be FKBP DD or ecDHFR DDs such as those listed in Table 2.

In some embodiments, binding ligand of FKBP DD may be Aquashield, which has considerably improved solubility in aqueous medium compared to Shield-1, but retains all the binding properties of Shield-1. The position of the mutated amino acid listed in Table 2 is relative to the ecDHFR (Uniprot ID: P0ABQ4) of SEQ ID NO. 4221 for ecDHFR DDs and relative to FKBP (Uniprot ID: P62942) of SEQ ID NO. 4222 for FKBP DDs.

TABLE 2 ecDHFR DDs and FKBPDDs

| DD | Sequence | SEQ ID NO: |
|---|---|---|
| ecDHFR (R12Y, Y100I) | MISLIAALAVDYVIGMENAMPWNLPADLAWFKRNTL NKPVIMGRHTWESIGRPLPGRKNIILSSQPGTDDRVTW VKSVDEAIAACGDVPEIMVIGGGRVIEQFLPKAQKLY LTHIDAEVEGDTHFPDYEPDDWESVFSEFHDADAQNS HSYCFEILERR | 1173 |
| ecDHFR (Amino acid 2-159 of WT) (R12Y, Y100I) | ISLIAALAVDYVIGMENAMPWNLPADLAWFKRNTLN KPVIMGRHTWESIGRPLPGRKNIILSSQPGTDDRVTWV KSVDEAIAACGDVPEIMVIGGGRVIEQFLPKAQKLYLT HIDAEVEGDTHFPDYEPDDWESVFSEFHDADAQNSHS YCFEILERR | 1174 |
| ecDHFR (Amino acid 2-159 of WT) (R12H, E129K) | ISLIAALAVDHVIGMENAMPWNLPADLAWFKRNTLN KPVIMGRHTWESIGRPLPGRKNIILSSQPGTDDRVTWV KSVDEAIAACGDVPEIMVIGGGRVYEQFLPKAQKLYL THIDAEVEGDTHFPDYKPDDWESVFSEFHDADAQNSH SYCFEILERR | 1175 |
| FKBP(F36V, L106P) | GVQVETISPGDGRTFPKRGQTCVVHYTGMLEDGKKV DSSRDRNKPFKFMLGKQEVIRGWEEGVAQMSVGQRA KLTISPDYAYGATGHPGIIPPHATLVFDVELLKPE | 1176 |
| FKBP(E31G, F36V, R71G, K105E) | GVQVETISPGDGRTFPKRGQTCVVHYTGMLGDGKKV DSSRDRNKPFKFMLGKQEVIRGWEEGVAQMSVGQGA KLTISPDYAYGATGHPGIIPPHATLVFDVELLELE | 1177 |

Inventors of the present invention have tested and identified several candidate human proteins that may be used to develop destabilizing domains. As show in Table 2, these candidates include human DHFR (hDHFR), PDE5 (phosphodiesterase 5), PPAR gamma (peroxisome proliferator-activated receptor gamma), CA2 (Carbonic anhydrase II) and NQO2 (NRH: Quinone oxidoreductase 2). Candidate destabilizing domain sequence identified from protein domains of these proteins (as a template) may be mutated to generate libraries of mutants based on the template candidate domain sequence. Mutagenesis strategies used to generate DD libraries may include site-directed mutagenesis e.g. by using structure guided information; or random mutagenesis e.g. using error-prone PCR, or a combination of both. In some embodiments, destabilizing domains identified using random mutagenesis may be used to identify structural properties of the candidate DDs that may be required for destabilization, which may then be used to further generate libraries of mutations using site directed mutagenesis.

Human DHFR Mutants

In some embodiments, DDs of the invention may be derived from human dihydrofolate reductase (DHFR). DHFR is a small (18 kDa) enzyme that catalyzes the reduction of dihydrofolate and plays a vital role in variety of anabolic pathway. Dihydrofolate reductase (DHFR) is an essential enzyme that converts 7,8-dihydrofolate (DHF) to 5,6,7,8, tetrahydrofolate (THF) in the presence of nicotinamide adenine dihydrogen phosphate (NADPH). Anti-folate drugs such as methotrexate (MTX), a structural analogue of folic acid, which bind to DHFR more strongly than the natural substrate DHF, interferes with folate metabolism, mainly by inhibition of dihydrofolate reductase, resulting in the suppression of purine and pyrimidine precursor synthesis. MTX is a common cancer therapy.

Dihydrofolate reductase (DHFR) from *Escherichia coli* and various *E. coli* DHFR (ecDHFR) mutants bind to known DHFR inhibitors: Methotrexate (MTX). Upon binding to MTX, DHFR shows conformational changes and changes in thermodynamic stability (Wallace et al., *J. Mol. Biol.*, 2002, 315:193-211) and such structural changes affect protein stability. Other inhibitors of DHFR: folate, TQD, Trimethoprim (TMP), epigallocatechin gallate (EGCG) and ECG (epicatechin gallate) can also bind to ecDHFR mutants and regulates its stability. In some embodiments, DDs of the present invention may be identified by utilizing a cocktail of DHFR inhibitors. In other instances, the suitable DDs may be identified by screening first with one DHFR inhibitor and subsequently screening with a second DHFR inhibitor.

In some embodiments, the destabilizing domains of the invention may include wildtype nucleotide sequences which may be utilized to reduce the basal expression of the compositions of the invention. Previous studies have shown that dihydrofolate reductase protein molecules can bind to their cognate mRNA and effectively repressing its translation. Alternatively, the nucleic acid sequence of the codons may be selected to alter translation rates. In some embodiments, amino acids identified as critical regulators of DHFR translation repression may be mutated to enhance translation rates. Examples of such mutations include but are not limited to I7A, R28A and F34S residues of wildtype DHFR protein, described by Tai N et al. (2002), *Nucleic Acids Res.* 30(20): 4481-4488; the contents of which are incorporated by reference in their entirety.

In accordance with the present invention, the structural properties of human DHFR protein were compared to those of ecDHFR and amino acid residues corresponding to known ecDHFR mutations having destabilizing properties were identified. Site directed mutagenesis of hDHFR protein was then used to generate several hDHFR mutants and their destabilization in the absence of its binding ligand was tested. Binding to DHFR ligands, MTX and TMP to human DHFR was tested and ligand dependent stabilization was characterized. Several hDHFR destabilizing mutants were discovered. The ecDHFR and hDHFR amino acid sequences and nucleotide sequences are provided in Table 3. In Table 3, the linkers are represented in bold and the restriction sites are underlined. The amino acid sequences in Table 3 may comprise a stop codon which is denoted in the table with a "*" at the end of the amino acid sequence.

TABLE 3

Sequences of hDHFR and ecDHFR and construct components

| Description | Amino Acid Sequence | Amino Acid SEQ ID NO. | Nucleic Acid SEQ ID NO. |
|---|---|---|---|
| Human DHFR (hDHFR)- wildtype (WT) (Uniprot ID: P00374) | MVGSLNCIVAVSQNMGIGKNGDLPWPPLRNEFRYFQRMTT TSSVEGKQNLVIMGKKTWFSIPEKNRPLKGRINLVLSRELKE PPQGAHFLSRSLDDALKLTEQPELANKVDMVWIVGGSSVY KEAMNHPGHLKLFVTRIMQDFESDTFFPEIDLEKYKLLPEY PGVLSDVQEEKGIKYKFEVYEKND | 1 | 4223 |
| E coli DHFR (ecDHFR)- wildtype (WT) (Uniprot ID: P0ABQ4) | MISLIAALAVDRVIGMENAMPWNLPADLAWFKRNTLNKPV IMGRHTWESIGRPLPGRKNIILSSQPGTDDRVTWVKSVDEAI AACGDVPEIMVIGGGRVYEQFLPKAQKLYLTHIDAEVEGDT HFPDYEPDDWESVFSEFHDADAQNSHSYCFEILERR | 1179 | 4224 |
| AcGFP1, sub cloned from pIRES2-AcGFP (Uniprot ID: BAE93141) | MVSKGAELFTGIVPILIELNGDVNGHKFSVSGEGEGDATYG KLTLKFICTTGKLPVPWPTLVTTLSYGVQCFSRYPDHMKQH DFFKSAMPEGYIQERTIFFEDDGNYKSRAEVKFEGDTLVNRI ELTGTDFKEDGNILGNKMEYNYNAHNVYIMTDKAKNGIKV NFKIRHNIEDGSVQLADHYQQNTPIGDGPVLLPDNHYLSTQ SALSKDPNEKRDHMIYFGFVTAAAITHGMDELYK | 1181 | 4225 |
| linker | GGSGGG | 1183 | 4226-4227 |
| hDHFR(wt)- Restriction Site (TS)-Linker (GGSGGG (SEQ ID NO: 2728))- AcGFP(N- terminal fusion polypeptide) | MVGSLNCIVAVSQNMGIGKNGDLPWPPLRNEFRYFQRMTT TSSVEGKQNLVIMGKKTWFSIPEKNRPLKGRINLVLSRELKE PPQGAHFLSRSLDDALKLTEQPELANKVDMVWIVGGSSVY KEAMNHPGHLKLFVTRIMQDFESDTFFPEIDLEKYKLLPEY PGVLSDVQEEKGIKYKFEVYEKNDTSGGSGGGMVSKGAEL FTGIVPILIELNGDVNGHKFSVSGEGEGDATYGKLTLKFICT TGKLPVPWPTLVTTLSYGVQCFSRYPDHMKQHDFFKSAMP EGYIQERTIFFEDDGNYKSRAEVKFEGDTLVNRIELTGTDFK EDGNILGNKMEYNYNAHNVYIMTDKAKNGIKVNFKIRHNI EDGSVQLADHYQQNTPIGDGPVLLPDNHYLSTQSALSKDP NEKRDHMIYFGFVTAAAITHGMDELYK* | 1186 | 4228 |
| AcGFP-Linker (GGSGGG (SEQ ID NO: 2728))- Restriction Site (TS)- hDHFR(Amino acid 2-187 of WT) (C-terminal fusion polypeptide) | MVSKGAELFTGIVPILIELNGDVNGHKFSVSGEGEGDATYG KLTLKFICTTGKLPVPWPTLVTTLSYGVQCFSRYPDHMKQH DFFKSAMPEGYIQERTIFFEDDGNYKSRAEVKFEGDTLVNRI ELTGTDFKEDGNILGNKMEYNYNAHNVYIMTDKAKNGIKV NFKIRHNIEDGSVQLADHYQQNTPIGDGPVLLPDNHYLSTQ SALSKDPNEKRDHMIYFGFVTAAAITHGMDELYKGGSGGG TSVGSLNCIVAVSQNMGIGKNGDLPWPPLRNEFRYFQRMT TTSSVEGKQNLVIMGKKTWFSIPEKNRPLKGRINLVLSRELK EPPQGAHFLSRSLDDALKLTEQPELANKVDMVWIVGGSSV YKEAMNHPGHLKLFVTRIMQDFESDTFFPEIDLEKYKLLPE YPGVLSDVQEEKGIKYKFEVYEKND* | 1187 | 4229 |
| ecDHFR(wt)- AcGFP(N- terminal fusion polypeptide) | MISLIAALAVDRVIGMENAMPWNLPADLAWFKRNTLNKPV IMGRHTWESIGRPLPGRKNIILSSQPGTDDRVTWVKSVDEAI AACGDVPEIMVIGGGRVYEQFLPKAQKLYLTHIDAEVEGDT HFPDYEPDDWESVFSEFHDADAQNSHSYCFEILERRGGSGG GMVSKGAELFTGIVPILIELNGDVNGHKFSVSGEGEGDATY GKLTLKFICTTGKLPVPWPTLVTTLSYGVQCFSRYPDHMKQ HDFFKSAMPEGYIQERTIFFEDDGNYKSRAEVKFEGDTLVN RIELTGTDFKEDGNILGNKMEYNYNAHNVYIMTDKAKNGI KVNFKIRHNIEDGSVQLADHYQQNTPIGDGPVLLPDNHYLS TQSALSKDPNEKRDHMIYFGFVTAAAITHGMDELYK* | 1188 | 4230 |

In some embodiments, the DHFR derived destabilizing domains may be derived from variants, and or isoforms of DHFR. The three isoforms of DHFR differ in their C and N terminal regions. Isoform 1 is the longest transcript and encodes the longest isoform and is represented by SEQ ID NO. 4231, encoded by SEQ ID NO. 4232. Isoform 2 lacks an alternate exon in the 5' end compared to isoform 1. This difference causes translation initiation at a downstream AUG and results in an isoform with a shorter N terminus compared to isoform 1. Isoform 2 is represented by SEQ ID NO. 4233, encoded by SEQ ID NO. 4234. Isoform 3 lacks an alternate exon in the 3' end compared to isoform 1, that causes frameshift. The resulting isoform has a shorter and distinct C terminus compared to isoform 1. Isoform 3 is represented by SEQ ID NO. 4235, encoded by SEQ ID NO. 4236.

In some embodiments, the first amino acid from the destabilizing domain may be removed or substituted when fused to the linker region or payload. As a non-limiting example, the first amino acid is methionine (M) and it is removed from the destabilizing domain.

DDs of the present invention may also be derived from DHFR variant. Masters J N et al. have described a DHFR variant (SEQ ID NO. 4237); which bears 80% identity and 48% query coverage to SEQ ID NO. 1 (Masters J N et al (1983). *J Mol Biol.;* 167(1):23-36; the contents of which are incorporated by reference in its entirety).

In some embodiments, the DDs of the present invention may be derived from Dihydrofolate reductase like 1 (DHFRL1) represented by SEQ ID NO. 4238, encoded by SEQ ID NO. 4239. DHFRL1 is a mitochondrial dihydrofolate reductase with similar enzymatic activity as DHFR. In some embodiments, the DDs of the invention may be derived from known variants of DHFR such as DHFRP1, DHFRP2, and DHFRP3. Such variants are described in Anagnou N P, et al. (1984) *PNAS* 81:5170-5174; Anagnou N P et al. (1988) *Am J Hum Genet* 42:345-352; Shimada T, (1984). *Gene* 31:1-8; Maurer B J et al. (1985) *Somatic Cell Mol Genet* 11:79-85; the contents of each of which are incorporated by reference in their entirety.

The amino acid sequences of the destabilizing domains encompassed in the invention have at least about 40%, 50% or 60%, 70% identity, preferably at least about 75% or 80% identity, more preferably at least about 85%, 86%, 87%, 88%, 89% or 90% identity, and further preferably at least about 91%, 92%, 93%, 94%, 95%, 96%, 97%, 98%, or 99% identity to the amino acid sequences described therein. Percent identity may be determined, for example, by comparing sequence information using the advanced BLAST computer program, including version Magic-BLAST 1.2.0, available from the National Institutes of Health. The BLAST program is based on the alignment method discussed in Karl and Altschul (1990) *Proc. Natl. Acad. Sci USA,* 87:2264-68 (the contents of which are incorporated by reference in their entirety).

In some embodiments, novel DDs of the present invention comprise mutants of human DHFR presented in Table 4. The position of the mutated amino acids listed in Table 4 is relative to the wildtype human DHFR (Uniprot ID: P00374) of SEQ ID NO. 1. In Table 4, mutations are underlined and in bold. The amino acid sequences in Table 2 may comprise a stop codon which is denoted in the table with a "*" at the end of the amino acid sequence.

TABLE 4

Human DHFR mutants and novel destabilizing domains

| Mutants | Amino acid Sequence | Amino Acid SEQ ID NO | Nucleic Acid SEQ ID NO |
|---|---|---|---|
| hDHFR (Y122I) | MVGSLNCIVAVSQNMGIGKNGDLPWPPLRNEFRYFQRMTTTSS VEGKQNLVIMGKKTWFSIPEKNRPLKGRINLVLSRELKEPPQGA HFLSRSLDDALKLTEQPELANKVDMVWIVGGSSVIKEAMNHP GHLKLFVTRIMQDFESDTFFPEIDLEKYKLLPEYPGVLSDVQEE KGIKYKFEVYEKND | 11 | 4240 |
| hDHFR (Amino acid 2-187 of WT) (Y122I) | VGSLNCIVAVSQNMGIGKNGDLPWPPLRNEFRYFQRMTTTSSV EGKQNLVIMGKKTWFSIPEKNRPLKGRINLVLSRELKEPPQGAH FLSRSLDDALKLTEQPELANKVDMVWIVGGSSVIKEAMNHPG HLKLFVTRIMQDFESDTFFPEIDLEKYKLLPEYPGVLSDVQEEK GIKYKFEVYEKND* | 13 | 4241 |
| hDHFR (M53T, R138I) | MVGSLNCIVAVSQNMGIGKNGDLPWPPLRNEFRYFQRMTTTSS VEGKQNLVITGKKTWFSIPEKNRPLKGRINLVLSRELKEPPQGA HFLSRSLDDALKLTEQPELANKVDMVWIVGGSSVYKEAMNHP GHLKLFVTIIMQDFESDTFFPEIDLEKYKLLPEYPGVLSDVQEEK GIKYKFEVYEKND | 21 | 4242 |
| hDHFR (Amino acid 2-187 of WT) (M53T, R138I) | VGSLNCIVAVSQNMGIGKNGDLPWPPLRNEFRYFQRMTTTSSV EGKQNLVITGKKTWFSIPEKNRPLKGRINLVLSRELKEPPQGAH FLSRSLDDALKLTEQPELANKVDMVWIVGGSSVYKEAMNHPG HLKLFVTIIMQDFESDTFFPEIDLEKYKLLPEYPGVLSDVQEEKG IKYKFEVYEKND | 36 | 4243 |
| hDHFR (V75F, Y122I) | MVGSLNCIVAVSQNMGIGKNGDLPWPPLRNEFRYFQRMTTTSS VEGKQNLVIMGKKTWFSIPEKNRPLKGRINLFLSRELKEPPQGA HFLSRSLDDALKLTEQPELANKVDMVWIVGGSSVIKEAMNHP GHLKLFVTRIMQDFESDTFFPEIDLEKYKLLPEYPGVLSDVQEE KGIKYKFEVYEKND | 27 | 4244 |
| hDHFR (Amino acid 2-187 of WT) (V75F, Y122I) | VGSLNCIVAVSQNMGIGKNGDLPWPPLRNEFRYFQRMTTTSSV EGKQNLVIMGKKTWFSIPEKNRPLKGRINLFLSRELKEPPQGAH FLSRSLDDALKLTEQPELANKVDMVWIVGGSSVIKEAMNHPG HLKLFVTRIMQDFESDTFFPEIDLEKYKLLPEYPGVLSDVQEEK GIKYKFEVYEKND | 40 | 4245 |
| hDHFR (Y122I, A125F,) | MVGSLNCIVAVSQNMGIGKNGDLPWPPLRNEFRYFQRMTTTSS VEGKQNLVIMGKKTWFSIPEKNRPLKGRINLVLSRELKEPPQGA HFLSRSLDDALKLTEQPELANKVDMVWIVGGSSVIKEFMNHPG HLKLFVTRIMQDFESDTFFPEIDLEKYKLLPEYPGVLSDVQEEK GIKYKFEVYEKND | 28 | 4246 |

TABLE 4-continued

Human DHFR mutants and novel destabilizing domains

| Mutants | Amino acid Sequence | Amino Acid SEQ ID NO | Nucleic Acid SEQ ID NO |
|---|---|---|---|
| hDHFR (Amino acid 2-187 of WT) (Y122I, A125F) | VGSLNCIVAVSQNMGIGKNGDLPWPPLRNEFRYFQRMTTTSSV EGKQNLVIMGKKTWFSIPEKNRPLKGRINLVLSRELKEPPQGAH FLSRSLDDALKLTEQPELANKVDMVWIVGGSSVIKEFMNHPGH LKLFVTRIMQDFESDTFFPEIDLEKYKLLPEYPGVLSDVQEEKGI KYKFEVYEKND* | 41 | 4247 |
| hDHFR (L74N, Y122I) | MVGSLNCIVAVSQNMGIGKNGDLPWPPLRNEFRYFQRMTTTSS VEGKQNLVIMGKKTWFSIPEKNRPLKGRINNVLSRELKEPPQG AHFLSRSLDDALKLTEQPELANKVDMVWIVGGSSVIKEAMNH PGHLKLFVTRIMQDFESDTFFPEIDLEKYKLLPEYPGVLSDVQE EKGIKYKFEVYEKND | 19 | 4248 |
| hDHFR (Amino acid 2-187 of WT) (L74N, Y122I) | VGSLNCIVAVSQNMGIGKNGDLPWPPLRNEFRYFQRMTTTSSV EGKQNLVIMGKKTWFSIPEKNRPLKGRINNVLSRELKEPPQGA HFLSRSLDDALKLTEQPELANKVDMVWIVGGSSVIKEAMNHP GHLKLFVTRIMQDFESDTFFPEIDLEKYKLLPEYPGVLSDVQEE KGIKYKFEVYEKND | 34 | 4249 |
| hDHFR (L94A, T147A) | MVGSLNCIVAVSQNMGIGKNGDLPWPPLRNEFRYFQRMTTTSS VEGKQNLVIMGKKTWFSIPEKNRPLKGRINLVLSRELKEPPQGA HFLSRSADDALKLTEQPELANKVDMVWIVGGSSVYKEAMNHP GHLKLFVTRIMQDFESDAFFPEIDLEKYKLLPEYPGVLSDVQEE KGIKYKFEVYEKND | 20 | 4250 |
| hDHFR (Amino acid 2-187 of WT) (L94A, T147A) | VGSLNCIVAVSQNMGIGKNGDLPWPPLRNEFRYFQRMTTTSSV EGKQNLVIMGKKTWFSIPEKNRPLKGRINLVLSRELKEPPQGAH FLSRSADDALKLTEQPELANKVDMVWIVGGSSVYKEAMNHPG HLKLFVTRIMQDFESDAFFPEIDLEKYKLLPEYPGVLSDVQEEK GIKYKFEVYEKND | 35 | 4251 |
| hDHFR (G21T, Y122I) | MVGSLNCIVAVSQNMGIGKNTDLPWPPLRNEFRYFQRMTTTSS VEGKQNLVIMGKKTWFSIPEKNRPLKGRINLVLSRELKEPPQGA HFLSRSLDDALKLTEQPELANKVDMVWIVGGSSVIKEAMNHP GHLKLFVTRIMQDFESDTFFPEIDLEKYKLLPEYPGVLSDVQEE KGIKYKFEVYEKND | 16 | 4252 |
| hDHFR (Amino acid 2-187 of WT) (G21T, Y122I) | VGSLNCIVAVSQNMGIGKNTDLPWPPLRNEFRYFQRMTTTSSV EGKQNLVIMGKKTWFSIPEKNRPLKGRINLVLSRELKEPPQGAH FLSRSLDDALKLTEQPELANKVDMVWIVGGSSVIKEAMNHPG HLKLFVTRIMQDFESDTFFPEIDLEKYKLLPEYPGVLSDVQEEK GIKYKFEVYEKND | 32 | 4253 |
| hDHFR (V121A, Y122I) | MVGSLNCIVAVSQNMGIGKNGDLPWPPLRNEFRYFQRMTTTSS VEGKQNLVIMGKKTWFSIPEKNRPLKGRINLVLSRELKEPPQGA HFLSRSLDDALKLTEQPELANKVDMVWIVGGSSAIKEAMNHP GHLKLFVTRIMQDFESDTFFPEIDLEKYKLLPEYPGVLSDVQEE KGIKYKFEVYEKND | 26 | 4254 |
| hDHFR (Amino acid 2-187 of WT) (V121A, Y122I) | VGSLNCIVAVSQNMGIGKNGDLPWPPLRNEFRYFQRMTTTSSV EGKQNLVIMGKKTWFSIPEKNRPLKGRINLVLSRELKEPPQGAH FLSRSLDDALKLTEQPELANKVDMVWIVGGSSAIKEAMNHPG HLKLFVTRIMQDFESDTFFPEIDLEKYKLLPEYPGVLSDVQEEK GIKYKFEVYEKND | 39 | 4255 |
| hDHFR (Q36K, Y122I) | MVGSLNCIVAVSQNMGIGKNGDLPWPPLRNEFRYFKRMTTTSS VEGKQNLVIMGKKTWFSIPEKNRPLKGRINLVLSRELKEPPQGA HFLSRSLDDALKLTEQPELANKVDMVWIVGGSSVIKEAMNHP GHLKLFVTRIMQDFESDTFFPEIDLEKYKLLPEYPGVLSDVQEE KGIKYKFEVYEKND | 23 | 4256 |
| hDHFR (Amino acid 2-187 of WT) (Q36K, Y122I) | VGSLNCIVAVSQNMGIGKNGDLPWPPLRNEFRYFKRMTTTSSV EGKQNLVIMGKKTWFSIPEKNRPLKGRINLVLSRELKEPPQGAH FLSRSLDDALKLTEQPELANKVDMVWIVGGSSVIKEAMNHPG HLKLFVTRIMQDFESDTFFPEIDLEKYKLLPEYPGVLSDVQEEK GIKYKFEVYEKND* | 38 | 4257, 4258 |

TABLE 4-continued

Human DHFR mutants and novel destabilizing domains

| Mutants | Amino acid Sequence | Amino Acid SEQ ID NO | Nucleic Acid SEQ ID NO |
|---|---|---|---|
| hDHFR (Q36F, N65F, Y122I) | MVGSLNCIVAVSQNMGIGKNGDLPWPPLRNEFRYFFRMTTTSS VEGKQNLVIMGKKTWFSIPEKFRPLKGRINLVLSRELKEPPQGA HFLSRSLDDALKLTEQPELANKVDMVWIVGGSSVIKEAMNHP GHLKLFVTRIMQDFESDTFFPEIDLEKYKLLPEYPGVLSDVQEE KGIKYKFEVYEKND | 49 | 4259 |
| hDHFR (Amino acid 2-187 of WT) (Q36F, N65F, Y122I) | VGSLNCIVAVSQNMGIGKNGDLPWPPLRNEFRYFFRMTTTSSV EGKQNLVIMGKKTWFSIPEKFRPLKGRINLVLSRELKEPPQGAH FLSRSLDDALKLTEQPELANKVDMVWIVGGSSVIKEAMNHPG HLKLFVTRIMQDFESDTFFPEIDLEKYKLLPEYPGVLSDVQEEK GIKYKFEVYEKND* | 56 | 4260 |
| hDHFR (Q36F, Y122I, A125F) | MVGSLNCIVAVSQNMGIGKNGDLPWPPLRNEFRYFFRMTTTSS VEGKQNLVIMGKKTWFSIPEKNRPLKGRINLVLSRELKEPPQGA HFLSRSLDDALKLTEQPELANKVDMVWIVGGSSVIKEFMNHPG HLKLFVTRIMQDFESDTFFPEIDLEKYKLLPEYPGVLSDVQEEK GIKYKFEVYEKND | 50 | 4261 |
| hDHFR (Amino acid 2-187 of WT) (Q36F, Y122I, A125F) | VGSLNCIVAVSQNMGIGKNGDLPWPPLRNEFRYFFRMTTTSSV EGKQNLVIMGKKTWFSIPEKNRPLKGRINLVLSRELKEPPQGAH FLSRSLDDALKLTEQPELANKVDMVWIVGGSSVIKEFMNHPGH LKLFVTRIMQDFESDTFFPEIDLEKYKLLPEYPGVLSDVQEEKGI KYKFEVYEKND | 57 | 4262 |

According to the present invention, several hDHFR destabilizing mutants were discovered by random mutagenesis of the wildtype human DHFR using error prone polymerase chain reaction (PCR). The destabilization of the mutants in the absence of its binding ligand was tested. Binding to DHFR ligands, MTX and TMP to human DHFR was also tested and ligand dependent stabilization was characterized.

Several hDHFR destabilizing mutants were discovered. The amino acid sequences of the DDs discovered by random mutagenesis are provided in Table 5. In Table 5, mutations are underlined and in bold. The position of the mutated amino acids listed in Table 5 is relative to the wildtype human DHFR (Uniprot ID: P00374) of SEQ ID NO. 1.

TABLE 5

Human DHFR mutants and new destabilizing domains

| Clone number | hDHFR Mutants | Amino acid Sequence | Amino Acid SEQ ID NO | Nucleic Acid SEQ ID NO. |
|---|---|---|---|---|
| Clone C1-12 | hDHFR (K81R) | MVGSLNCIVAVSQNMGIGKNGDLPWPPLRNE FRYFQRMTTTSSVEGKQNLVIMGKKTWFSIPE KNRPLKGRINLVLSRELREPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEKND | 6 | 4263 |
| Clone C1-18 | hDHFR (V9A, S93R, P150L) | MVGSLNCIAAVSQNMGIGKNGDLPWPPLRNE FRYFQRMTTTSSVEGKQNLVIMGKKTWFSIPE KNRPLKGRINLVLSRELKEPPQGAHFLSRRLD DALKLTEQPELANKVDMVWIVGGSSVYKEA MNHPGHLKLFVTRIMQDFESDTFFLEIDLEKY KLLPEYPGVLSDVQEEKGIKYKFEVYEKND | 52 | 4264 |
| Clone C1-4 | hDHFR (F59S) | MVGSLNCIVAVSQNMGIGKNGDLPWPPLRNE FRYFQRMTTTSSVEGKQNLVIMGKKTWSSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEKND | 3 | 4265 |
| Clone C1-8 | hDHFR (I17V) | MVGSLNCIVAVSQNMGVGKNGDLPWPPLRN EFRYFQRMTTTSSVEGKQNLVIMGKKTWFSIP EKNRPLKGRINLVLSRELKEPPQGAHFLSRSL | 4 | 4266 |

TABLE 5-continued

Human DHFR mutants and new destabilizing domains

| Clone number | hDHFR Mutants | Amino acid Sequence | Amino Acid SEQ ID NO | Nucleic Acid SEQ ID NO. |
|---|---|---|---|---|
| | | DDALKLTEQPELANKVDMVWIVGGSSVYKE AMNHPGHLKLFVTRIMQDFESDTFFPEIDLEK YKLLPEYPGVLSDVQEEKGIKYKFEVYEKND | | |
| Clone C1-11 | hDHFR (N65D) | MVGSLNCIVAVSQNMGIGKNGDLPWPPLRNE FRYFQRMTTTSSVEGKQNLVIMGKKTWFSIPE KDRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEKND | 10 | 4267 |
| Clone C2-21 | hDHFR (A10V, H88Y) | MVGSLNCIVVVSQNMGIGKNGDLPWPPLRNE FRYFQRMTTTSSVEGKQNLVIMGKKTWFSIPE KNRPLKGRINLVLSRELKEPPQGAYFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEKND | 12 | 4268 |
| Clone C1-3 | hDHFR (A107V) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELVNKVDMVWIVGGSSVYKEA MNHPGHLKLFVTRIMQDFESDTFFPEIDLEKY KLLPEYPGVLSDVQEEKGIKYKFEVYEKND | 2 | 4269 |
| Clone C1-10 | hDHFR (C7R, Y163C) | MVGSLNRIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPECPGVLSDVQEEKGIKYKFEVYEKND | 14 | 4270 |
| Clone C1-14 | hDHFR (N127Y) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MYHPGHLKLFVTRIMQDFESDTFFPEIDLEKY KLLPEYPGVLSDVQEEKGIKYKFEVYEKND | 8 | 4271 |
| Clone C1-21 | hDHFR (K185E) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEEND | 5 | 4272 |
| Clone C1-25 | hDHFR (T137R, F143L) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVRRIMQDLESDTFFPEIDLEKY KLLPEYPGVLSDVQEEKGIKYKFEVYEKND | 24 | 4273 |
| Clone C2-8 | hDHFR (I8V, K133E, Y163C) | MVGSLNCVVAVSQNMGIGKNGDLPWPPLRN EFRYFQRMTTTSSVEGKQNLVIMGKKTWFSIP EKNRPLKGRINLVLSRELKEPPQGAHFLSRSL DDALKLTEQPELANKVDMVWIVGGSSVYKE AMNHPGHLELFVTRIMQDFESDTFFPEIDLEK YKLLPECPGVLSDVQEEKGIKYKFEVYEKND | 45 | 4274 |
| Clone C2-15 | hDHFR (K19E, F89L, E181G) | MVGSLNCIVAVSQNMGIGENGDLPWPPLRNE FRYFQRMTTTSSVEGKQNLVIMGKKTWFSIPE KNRPLKGRINLVLSRELKEPPQGAHLLSRSLD DALKLTEQPELANKVDMVWIVGGSSVYKEA MNHPGHLKLFVTRIMQDFESDTFFPEIDLEKY KLLPEYPGVLSDVQEEKGIKYKFGVYEKND | 46 | 4275 |
| Clone C2-20 | hDHFR (N186D) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEKDD | 9 | 4276 |

TABLE 5-continued

Human DHFR mutants and new destabilizing domains

| Clone number | hDHFR Mutants | Amino acid Sequence | Amino Acid SEQ ID NO | Nucleic Acid SEQ ID NO. |
|---|---|---|---|---|
| Clone C2-22 | hDHFR (G54R, I115L, M140V, S168C) | MVGSLNCIVAVSQNMGIGKNGDLPWPPLRNE FRYFQRMTTTSSVEGKQNLVIMRKKTWFSIPE KNRPLKGRINLVLSRELKEPPQGAHFLSRSLD DALKLTEQPELANKVDMVWLVGGSSVYKEA MNHPGHLKLFVTRIVQDFESDTFFPEIDLEKY KLLPEYPGVLCDVQEEKGIKYKFEVYEKND | 54 | 4277 |
| Clone C2-23 | hDHFR (L23S, V121A, Y157C) | MVGSLNCIVAVSQNMGIGKNGDSPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSAYKEA MNHPGHLKLFVTRIMQDFESDTFFPEIDLEKC KLLPEYPGVLSDVQEEKGIKYKFEVYEKND | 47 | 4278 |
| Clone C1-24 | hDHFR (V110A, V136M, K177R) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKADMVWIVGGSSVYKEA MNHPGHLKLFMTRIMQDFESDTFFPEIDLEKY KLLPEYPGVLSDVQEEKGIRYKFEVYEKND | 51 | 4279 |
| Clone C2-25 | hDHFR (E162G, I176F) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPGYPGVLSDVQEEKGFKYKFEVYEKND | 15 | 4280 |
| Clone C3-1 | hDHFR (Y178H, E181G) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKHKFGVYEKND | 30 | 4281 |
| Clone C3-2 | hDHFR (N49D, F59S, D153G) | MVGSLNCIVAVSQNMGIGKNGDLPWPPLRNE FRYFQRMTTTSSVEGKQDLVIMGKKTWSSIPE KNRPLKGRINLVLSRELKEPPQGAHFLSRSLD DALKLTEQPELANKVDMVWIVGGSSVYKEA MNHPGHLKLFVTRIMQDFESDTFFPEIGLEKY KLLPEYPGVLSDVQEEKGIKYKFEVYEKND | 48 | 4282 |
| Clone C3-3 | hDHFR (M140I) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIIQDFESDTFFPEIDLEKYK LLPEYPGVLSDVQEEKGIKYKFEVYEKND | 7 | 4283 |
| Clone C3-9 | hDHFR (H131R, E144G) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGRLKLFVTRIMQDFGSDTFFPEIDLEKY KLLPEYPGVLSDVQEEKGIKYKFEVYEKND | 17 | 4284 |
| Clone C3-22 | hDHFR (T57A, I72A) | MVGSLNCIVAVSQNMGIGKNGDLPWPPLRNE FRYFQRMTTTSSVEGKQNLVIMGKKAWFSIPE KNRPLKGRANLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEKND | 25 | 4285 |
| Clone C3-10 | hDHFR (Y183H, K185E) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVHEEND | 31 | 4286 |

TABLE 5-continued

Human DHFR mutants and new destabilizing domains

| Clone number | hDHFR Mutants | Amino acid Sequence | Amino Acid SEQ ID NO | Nucleic Acid SEQ ID NO. |
|---|---|---|---|---|
| Clone C4-3 | hDHFR (G21E, I72V, I176T) | MVGSLNCIVAVSQNMGIGKNEDLPWPPLRNE FRYFQRMTTTSSVEGKQNLVIMGKKTWFSIPE KNRPLKGRVNLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGTKYKFEVYEKND | 44 | 4287 |
| Clone C1-2 | hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKPTGRSGLADKVDMARIVGGSSVCKEAI RYPGHPKLPVTRTMQDFESDTSLPEVALEKY KLLPEYPGVLSGAQEEKGARYKFEAYERSD | 70 | 4288 |
| Clone C1-5 | hDHFR (V2A, R33G, Q36R, L100P, K185R) | MAGSLNCIVAVSQNMGIGKNGDLPWPPLRNE FGYFRRMTTTSSVEGKQNLVIMGKKTWFSIPE KNRPLKGRINLVLSRELKEPPQGAHFLSRSLD DALKPTEQPELANKVDMVWIVGGSSVYKEA MNHPGHLKLFVTRIMQDFESDTFFPEIDLEKY KLLPEYPGVLSDVQEEKGIKYKFEVYERND | 59 | 4289 |
| Clone C1-6 | hDHFR (G16S, I17V, F89L, D96G, K123E, M140V, D146G, K156R) | MVGSLNCIVAVSQNMSVGKNGDLPWPPLRN EFRYFQRMTTTSSVEGKQNLVIMGKKTWFSIP EKNRPLKGRINLVLSRELKEPPQGAHLLSRSL DGALKLTEQPELANKVDMVWIVGGSSVYEE AMNHPGHLKLFVTRIVQDFESGTFFPEIDLER YKLLPEYPGVLSDVQEEKGIKYKFEVYEKND | 63 | 4290 |
| Clone C1-13 | hDHFR (F35L, R37G, N65A, L68S, K69E, R71G, L80P, K99G, G117D, L132P, I139V, M140I, D142G, D146G, E173G, D187G) | MVGSLNCIVAVSQNMGIGKNGDLPWPPLRNE FRYLQGMTTTSSVEGKQNLVIMGKKTWFSIPE KARPSEGGINLVLSREPKEPPQGAHFLSRSLD DALGLTEQPELANKVDMVWIVDGSSVYKEA MNHPGHPKLFVTRVIQGFESGTFFPEIDLEKY KLLPEYPGVLSDVQEGKGIKYKFEVYEKNG | 67 | 4291 |
| Clone C1-23 | hDHFR (I17N, L98S, K99R, M112T, E151G, E162G, E172G) | MVGSLNCIVAVSQNMGNGKNGDLPWPPLRN EFRYFQRMTTTSSVEGKQNLVIMGKKTWFSIP EKNRPLKGRINLVLSRELKEPPQGAHFLSRSL DDASRLTEQPELANKVDTVWIVGGSSVYKEA MNHPGHLKLFVTRIMQDFESDTFFPGIDLEKY KLLPGYPGVLSDVQGEKGIKYKFEVYEKND | 62 | 4292 |
| Clone C4-2 | hDHFR (R138G, D142G, F143S, K156R, K158E, E162G, V166A, K177E, Y178C, K185E, N186S) | MVGSLNCIVAVSQNMGIGKNGDLPWPPLRNE FRYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTGIMQGSESDTFFPEIDLERY ELLPGYPGALSDVQEEKGIECKFEVYEESD | 65 | 4293 |
| Clone C4-5 | hDHFR (K81R, K99R, L100P, E102G, N108D, K123R, H128R, D142G, F180L, K185E) | MVGSLNCIVAVSQNMGIGKNGDLPWPPLRNE FRYFQRMTTTSSVEGKQNLVIMGKKTWFSIPE KNRPLKGRINLVLSRELREPPQGAHFLSRSLD DALRPTGQPELADKVDMVWIVGGSSVYREA MNRPGHLKLFVTRIMQGFESDTFFPEIDLEKY KLLPEYPGVLSDVQEEKGIKYKLEVYEEND | 64 | 4294 |

TABLE 5-continued

Human DHFR mutants and new destabilizing domains

| Clone number | hDHFR Mutants | Amino acid Sequence | Amino Acid SEQ ID NO | Nucleic Acid SEQ ID NO. |
|---|---|---|---|---|
| Clone C2-2 | hDHFR (N14S, P24S, F35L, M53T, K56E, R92G, S93G, N127S, H128Y, F135L, F143S, L159P, L160P, E173A, F180L) | MVGSLNCIVAVSQSMGIGKNGDLSWPPLRNE FRYLQRMTTTSSVEGKQNLVITGKETWFSIPE KNRPLKGRINLVLSRELKEPPQGAHFLSGGLD DALKLTEQPELANKVDMVWIVGGSSVYKEA MSYPGHLKLLVTRIMQDSESDTFFPEIDLEKY KPPPEYPGVLSDVQEAKGIKYKLEVYEKND | 66 | 4295 |
| Clone C3-6 | hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S) | MAGSLNCIVAVSQNMGVGKNGDLPWPPLRD GFRYFRRMTTTSSVEGKQNLVIMGKKTWSSIP EKNRPLEGRTNLVLSRELKEPPQGAYLLSRSL DDALKLTEQPELADEAGMVWVVGGSSVDKE AMNHPGHPKLSVTRIVQDFGSDAFFPEIDLEK CKLLPEYPGVLSDAQEERGIKYKFEVYEKSD | 69 | 4296 |
| Clone C3-8 | hDHFR (L28P, N30H, M38V, V44A, L68S, N73G, R78G, A97T, K99R, A107T, K109R, D111N, L134P, F135V, T147A, I152V, K158R, E172G, V182A, E184R) | MVGSLNCIVAVSQNMGIGKNGDLPWPPPRHE FRYFQRVTTTSSAEGKQNLVIMGKKTWFSIPE KNRPSKGRIGLVLSGELKEPPQGAHFLSRSLD DTLRLTEQPELTNRVNMVWIVGGSSVYKEAM NHPGHLRPVVTRIMQDFESDAFFPEVDLEKYR LLPEYPGVLSDVQGEKGIKYKFEAYRKND | 68 | 4297 |
| Clone C3-11 | hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N) | MVGSLNCIVTVSRSMGIGKDGDLSWPPLRSEF RYFQRTTATSSVEGRQSLVIMGKRTWFSTPER NRPLRGRANLVLSGELKGPPQGAHLLSRSLD GALKLTEQPELADKVDVVRIVGGSSVDEEAM NHPGHLKLFVTRVMRGFESDTLFPGIDLGKRK LLPEYPGVLSDVREEKGIKYKLEVCGNN | 2745 | 4298 |

Any of the mutations described in Table 4 may be combined with any of the mutations described in Table 5 to generate destabilizing domains. Exemplary combinations of mutations include, but are not limited to, hDHFR (I17V, Y122I) (SEQ ID NO. 4299 (amino acid 2-187 of WT, I17V, Y122I) (encoded by SEQ ID NO. 4300) or SEQ ID NO. 4301 (I17V, Y122I) (encoded by SEQ ID NO. 4302)), hDHFR (Y122I, M140I) (SEQ ID NO. 4303 (amino acid 2-187 of WT, Y122I, M140I) (encoded by SEQ ID NO. 4304) or SEQ ID NO. 4305 (Y122I, M140I) (encoded by SEQ ID NO. 4306)), hDHFR (N127Y, Y122I) (SEQ ID NO. 4307 (amino acid 2-187 of WT, N127Y, Y122I) (encoded by SEQ ID NO. 4308) or SEQ ID NO. 4309 (N127Y, Y122I) (encoded by SEQ ID NO. 4310)), and hDHFR (Y122I, H131R, E144G) (SEQ ID NO. 4311 (amino acid 2-187 of WT, Y122I, H131R, E144G) (encoded by SEQ ID NO. 4312) or SEQ ID NO. 4313 (Y122I, H131R, E144G) (encoded by SEQ ID NO. 4314). The position of the mutated amino acids is relative to the wildtype human DHFR (Uniprot ID: P00374) of SEQ ID NO. 1.

In some embodiments, the DDs may be derived from hDHFR by mutating one or more amino acids residues between positions 1-10, 10-20, 20-30, 30-40, 40-50, 50-60, 60-70, 70-80, 80-90, 90-100, 100-110, 110-120, 120-130, 130-140, 140-150, 150-160, 160-170, 170-180 or 180-187 of human DHFR wildtype protein (SEQ ID NO. 1). In some embodiments, the mutation may be a conserved (with similar physicochemical properties as the amino acid at the mutation site), a semi conserved (e.g. negatively to positively charge amino acid) or a non-conserved (amino acid with different physicochemical properties than the amino acid at the mutation site). Regions or portions or domains of wild type proteins may be utilized as SREs/DDs in whole or in part. They may be combined or rearranged to create new peptides, proteins, regions or domains of which any may be used as SREs/DDs or the starting point for the design of further SREs and/or DDs.

In some embodiments, novel DDs derived from *E. coli* DHFR (ecDHFR) may comprise amino acids 2-159 of the wild type ecDHFR sequence. This may be referred to as an M1del mutation.

In some embodiments, novel DDs derived from ecDHFR may comprise amino acids 2-159 of the wild type ecDHFR sequence (also referred to as an M1del mutation), and may include one, two, three, four, five or more mutations including, but not limited to, M1del, R12Y, R12H, Y100I, and E129K.

In some embodiments, novel DDs derived from FKBP may comprise amino acids 2-107 of the wild type FKBP sequence. This may be referred to as an M1del mutation. In some embodiments, novel DDs derived from FKBP may comprise amino acids 2-107 of the wild type FBKP sequence (also referred to as an M1del mutation), and may include one, two, three, four, five or more mutations including, but not limited to, M1del, E31G, F36V, R71G, K105E, and L106P.

In some embodiments, novel DDs derived from *E. coli* DHFR (ecDHFR) may comprise amino acids 2-159 of the wild type ecDHFR sequence (SEQ ID NO. 4315). This may be referred to as an M1del mutation.

In some embodiments, novel DDs derived from ecDHFR may comprise amino acids 2-159 of the wild type ecDHFR sequence (SEQ ID NO. 4315) (also referred to as an M1del mutation), and may include one, two, three, four, five or more mutations including, but not limited to, M1del, R12Y, R12H, Y100I, and E129K.

In some embodiments, novel DDs derived from FKBP may comprise amino acids 2-107 of the wild type FKBP sequence (SEQ ID NO. 4316). This may be referred to as an M1del mutation.

In some embodiments, novel DDs derived from FKBP may comprise amino acids 2-107 of the wild type FBKP sequence (SEQ ID NO. 4316) (also referred to as an M1del mutation), and may include one, two, three, four, five or more mutations including, but not limited to, M1del, E31G, F36V, R71G, K105E, and L106P.

In some embodiments, DD mutant libraries may be screened for mutations with altered, preferably higher binding affinity to the ligand, as compared to the wild type protein. DD libraries may also be screened using two or more ligands and DD mutations that are stabilized by some ligands but not others may be preferentially selected. DD mutations that bind preferentially to the ligand compared to a naturally occurring protein may also be selected. Such methods may be used to optimize ligand selection and ligand binding affinity of the DD. Additionally, such approaches can be used to minimize deleterious effects caused by off-target ligand binding.

In some embodiments, suitable DDs may be identified by screening mutant libraries using barcodes. Such methods may be used to detect, identify and quantify individual mutant clones within the heterogeneous mutant library. Each DD mutant within the library may have distinct barcode sequences (with respect to each other). In other instances, the polynucleotides can also have different barcode sequences with respect to 2, 3, 4, 5, 6, 7, 8, 9, 10 or more nucleic acid bases. Each DD mutant within the library may also comprise a plurality of barcode sequences. When used in plurality may be used such that each barcode is unique to any other barcode. Alternatively, each barcode used may not be unique, but the combination of barcodes used may create a unique sequence that can be individually tracked. The barcode sequence may be placed upstream of the SRE, downstream of the SRE, or in some instances may be placed within the SRE. DD mutants may be identified by barcodes using sequencing approaches such as Sanger sequencing, and next generation sequencing, but also by polymerase chain reaction and quantitative polymerase chain reaction. In some embodiments, polymerase chain reaction primers that amplify a different size product for each barcode may be used to identify each barcode on an agarose gel. In other instances, each barcode may have a unique quantitative polymerase chain reaction probe sequence that enables targeted amplification of each barcode.

In some embodiments, DDs of the invention may be derived from human dihydrofolate reductase (hDHFR). hDHFR is a small (18 kDa) enzyme that catalyzes the reduction of dihydrofolate and plays a vital role in variety of anabolic pathway. Dihydrofolate reductase (DHFR) is an essential enzyme that converts 7,8-dihydrofolate (DHF) to 5,6,7,8, tetrahydrofolate (THF) in the presence of nicotinamide adenine dihydrogen phosphate (NADPH). Anti-folate drugs such as methotrexate (MTX), a structural analogue of folic acid, which bind to DHFR more strongly than the natural substrate DHF, interferes with folate metabolism, mainly by inhibition of dihydrofolate reductase, resulting in the suppression of purine and pyrimidine precursor synthesis. Other inhibitors of hDHFR such as folate, TQD, Trimethoprim (TMP), epigallocatechin gallate (EGCG) and ECG (epicatechin gallate) can also bind to hDHFR mutants and regulates its stability. In one aspect of the invention, the DDs of the invention may be hDHFR mutants including the single mutation hDHFR (Y122I), hDHFR (K81R), hDHFR (F59S), hDHFR (I17V), hDHFR (N65D), hDHFR (A107V), hDHFR (N127Y), hDHFR (K185E), hDHFR (N186D), and hDHFR (M140I); double mutations: hDHFR (M53T, R138I), hDHFR (V75F, Y122I), hDHFR (A125F, Y122I), hDHFR (L74N, Y122I), hDHFR (L94A, T147A), hDHFR (G21T, Y122I), hDHFR (V121A, Y122I), hDHFR (Q36K, Y122I), hDHFR (C7R, Y163C), hDHFR (Y178H, E181G), hDHFR (A10V, H88Y), hDHFR (T137R, F143L), hDHFR (E63G, I176F), hDHFR (T57A, I72A), hDHFR (H131R, E144G), and hDHFR (Y183H, K185E); and triple mutations: hDHFR (Q36F, N65F, Y122I), hDHFR (G21E, I72V, I176T), hDHFR (I8V, K133E, Y163C), hDHFR (V9A, S93R, P150L), hDHFR (K19E, F89L, E181G), hDHFR (G54R, M140V, S168C), hDHFR (L23S, V121A, Y157C), hDHFR (V110A, V136M, K177R), and hDHFR (N49D, F59S, D153G).

In some embodiments, DDs of the invention may be derived from human dihydrofolate reductase (hDHFR). hDHFR is a small (18 kDa) enzyme that catalyzes the reduction of dihydrofolate and plays a vital role in variety of anabolic pathway. Dihydrofolate reductase (DHFR) is an essential enzyme that converts 7,8-dihydrofolate (DHF) to 5,6,7,8, tetrahydrofolate (THF) in the presence of nicotinamide adenine dihydrogen phosphate (NADPH). Anti-folate drugs such as methotrexate (MTX), a structural analogue of folic acid, which bind to DHFR more strongly than the natural substrate DHF, interferes with folate metabolism, mainly by inhibition of dihydrofolate reductase, resulting in the suppression of purine and pyrimidine precursor synthesis. Other inhibitors of hDHFR such as folate, TQD, Trimethoprim (TMP), epigallocatechin gallate (EGCG) and ECG (epicatechin gallate) can also bind to hDHFR mutants and regulates its stability. In one aspect of the invention, the DDs of the invention may be hDHFR mutants including the single mutation hDHFR (Y122I), hDHFR (K81R), hDHFR (F59S), hDHFR (I17V), hDHFR (N65D), hDHFR (A107V), hDHFR (N127Y), hDHFR (K185E), hDHFR (N186D), and hDHFR (M140I); double mutations: hDHFR (M53T, R138I), hDHFR (V75F, Y122I), hDHFR (A125F, Y122I), hDHFR (L74N, Y122I), hDHFR (L94A, T147A), hDHFR (G21T, Y122I), hDHFR (V121A, Y122I), hDHFR (Q36K, Y122I), hDHFR (C7R, Y163C), hDHFR (Y178H, E181G), hDHFR (A10V, H88Y), hDHFR (T137R, F143L), hDHFR (E63G, I176F), hDHFR (T57A, I72A), hDHFR (H131R, E144G), and hDHFR (Y183H, K185E); and triple mutations: hDHFR (Q36F, N65F, Y122I), hDHFR (G21E, I72V, I176T), hDHFR (I8V, K133E, Y163C), hDHFR (V9A, S93R, P150L), hDHFR (K19E, F89L, E181G), hDHFR (G54R, M140V, S168C), hDHFR (L23S, V121A, Y157C), hDHFR (V110A, V136M, K177R), hDHFR (N49D, F59S, D153G) and hDHFR (N49D, F59S, D153G).

In one aspect of the invention, the DHFR DDs of the invention may include mutations such as, but not limited to V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I15V, V 161, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In one embodiment, the stimulus is a small molecule that binds to a SRE to post-translationally regulate protein levels. In one aspect, DHFR ligands: trimethoprim (TMP) and methotrexate (MTX) are used to stabilize hDHFR mutants. The hDHFR based destabilizing domains are listed in Table 6. The position of the mutated amino acid listed in Table 6 is relative to the human DHFR (Uniprot ID: P00374) of SEQ ID NO. 4317 for human DHFR. In Table 6, "del" means that the mutation is the deletion of the amino acid at that position relative to the wild type sequence.

TABLE 6

Human DHFR mutants and novel destabilizing domains

| Mutants | Amino acid Sequence | SEQ ID NO |
|---|---|---|
| hDHFR (I17V) | MVGSLNCIVAVSQNMGVGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMNHPGHLKLFVTRIMQDFESDTFFPEID LEKYKLLPEYPGVLSDVQEEKGIKYKFENYEKND | 1197 |
| hDHFR (F59S) | MVGSLNCIVAVSQNMGIGKNGDLPWPPLRNEFRYFQR MTTTSSVEGKQNLVIMGKKTWSSIPEKNRPLKGRINLVL SRELKEPPQGAHFLSRSLDDALKLTEQPELANKVDMVW IVGGSSVYKEAMNHPGHLKLFVTRIMQDFESDTFFPEID LEKYKLLPEYPGVLSDVQEEKGIKYKFENYEKND | 1198 |
| hDHFR (N65D) | MVGSLNCIVAVSQNMGIGKNGDLPWPPLRNEFRYFQR MTTTSSVEGKQNLVIMGKKTWFSIPEKDRPLKGRINLVL SRELKEPPQGAHFLSRSLDDALKLTEQPELANKVDMVW IVGGSSVYKEAMNHPGHLKLFVTRIMQDFESDTFFPEID LEKYKLLPEYPGVLSDVQEEKGIKYKFENYEKND | 1199 |
| hDHFR (K81R) | MVGSLNCIVAVSQNMGIGKNGDLPWPPLRNEFRYFQR MTTTSSVEGKQNLVIMGKKTWFSIPEKNRPLKGRINLVL SRELREPPQGAHFLSRSLDDALKLTEQPELANKVDMVW IVGGSSVYKEAMNHPGHLKLFVTRIMQDFESDTFFPEID LEKYKLLPEYPGVLSDVQEEKGIKYKFENYEKND | 1200 |
| hDHFR (A107V) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELVNKVDMVW IVGGSSVYKEAMNHPGHLKLFVTRIMQDFESDTFFPEID LEKYKLLPEYPGVLSDVQEEKGIKYKFENYEKND | 1201 |
| hDHFR (Y122I) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVIKEAMNHPGHLKLFVTRIMQDFESDTFFPEIDL EKYKLLPEYPGVLSDVQEEKGIKYKFEVYEKND | 1202 |
| hDHFR (N127Y) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMYHPGHLKLFVTRIMQDFESDTFFPEID LEKYKLLPEYPGVLSDVQEEKGIKYKFENYEKND | 1203 |

TABLE 6-continued

Human DHFR mutants and novel destabilizing domains

| Mutants | Amino acid Sequence | SEQ ID NO |
|---|---|---|
| hDHFR (M140I) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMNHPGHLKLFVTRIIQDFESDTFFPEIDL EKYKLLPEYPGVLSDVQEEKGIKYKFEVYEKND | 1204 |
| hDHFR (K185E) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMNHPGHLKLFVTRIMQDFESDTFFPEID LEKYKLLPEYPGVLSDVQEEKGIKYKFENYEEND | 1205 |
| hDHFR (N186D) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMNHPGHLKLFVTRIMQDFESDTFFPEID LEKYKLLPEYPGVLSDVQEEKGIKYKFENYEKDD | 1206 |
| hDHFR (C7R, Y163C) | MVGSLNRIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMNHPGHLKLFVTRIMQDFESDTFFPEID LEKYKLLPECPGVLSDVQEEKGIKYKFEVYEKND | 1207 |
| hDHFR (A10V, H88Y) | MVGSLNCIVVVSQNMGIGKNGDLPWPPLRNEFRYFQR MTTTSSVEGKQNLVIMGKKTWFSIPEKNRPLKGRINLVL SRELKEPPQGAYFLSRSLDDALKLTEQPELANKVDMVW IVGGSSVYKEAMNHPGHLKLFVTRIMQDFESDTFFPEID LEKYKLLPEYPGVLSDVQEEKGIKYKFENYEKND | 1208 |
| hDHFR (Q36K, Y122I) | MVGSLNCIVAVSQNMGIGKNGDLPWPPLRNEFRYFKR MTTTSSVEGKQNLVIMGKKTWFSIPEKNRPLKGRINLVL SRELKEPPQGAHFLSRSLDDALKLTEQPELANKVDMVW IVGGSSVIKEAMNHPGHLKLFVTRIMQDFESDTFFPEIDL EKYKLLPEYPGVLSDVQEEKGIKYKFEVYEKND | 1209 |
| hDHFR (M53T, R138I) | MVGSLNCIVAVSQNMGIGKNGDLPWPPLRNEFRYFQR MTTTSSVEGKQNLVITGKKTWFSIPEKNRPLKGRINLVL SRELKEPPQGAHFLSRSLDDALKLTEQPELANKVDMVW IVGGSSVYKEAMNHPGHLKLFVTIIMQDFESDTFFPEIDL EKYKLLPEYPGVLSDVQEEKGIKYKFEVYEKND | 1210 |
| hDHFR (T57A, I72A) | MVGSLNCIVAVSQNMGIGKNGDLPWPPLRNEFRYFQR MTTTSSVEGKQNLVIMGKKAWFSIPEKNRPLKGRANLV LSRELKEPPQGAHFLSRSLDDALKLTEQPELANKVDMV WIVGGSSVYKEAMNHPGHLKLFVTRIMQDFESDTFFPEI DLEKYKLLPEYPGVLSDVQEEKGIKYKFEVYEKND | 1211 |
| hDHFR (E63G, I176F) | MVGSLNCIVAVSQNMGIGKNGDLPWPPLRNEFRYFQR MTTTSSVEGKQNLVIMGKKTWFSIPGKNRPLKGRINLVL SRELKEPPQGAHFLSRSLDDALKLTEQPELANKVDMVW IVGGSSVYKEAMNHPGHLKLFVTRIMQDFESDTFFPEID LEKYKLLPEYPGVLSDVQEEKGFKYKFEVYEKND | 1212 |
| hDHFR (G21T, Y122I) | MVGSLNCIVAVSQNMGIGKNTDLPWPPLRNEFRYFQRM TTTSSVEGKQNLVIMGKKTWFSIPEKNRPLKGRINLVLS RELKEPPQGAHFLSRSLDDALKLTEQPELANKVDMVWI VGGSSVIKEAMNHPGHLKLFVTRIMQDFESDTFFPEIDL EKYKLLPEYPGVLSDVQEEKGIKYKFEVYEKND | 1213 |
| hDHFR (L74N, Y122I) | MVGSLNCIVAVSQNMGIGKNGDLPWPPLRNEFRYFQR MTTTSSVEGKQNLVIMGKKTWFSIPEKNRPLKGRINNVL SRELKEPPQGAHFLSRSLDDALKLTEQPELANKVDMVW IVGGSSVIKEAMNHPGHLKLFVTRIMQDFESDTFFPEIDL EKYKLLPEYPGVLSDVQEEKGIKYKFEVYEKND | 1214 |
| hDHFR (V75F, Y122I) | MVGSLNCIVAVSQNMGIGKNGDLPWPPLRNEFRYFQR MTTTSSVEGKQNLVIMGKKTWFSIPEKNRPLKGRINLFL SRELKEPPQGAHFLSRSLDDALKLTEQPELANKVDMVW IVGGSSVIKEAMNHPGHLKLFVTRIMQDFESDTFFPEIDL EKYKLLPEYPGVLSDVQEEKGIKYKFEVYEKND | 1215 |
| hDHFR (L94A, T147A) | MVGSLNCIVAVSQNMGIGKNGDLPWPPLRNEFRYFQR MTTTSSVEGKQNLVIMGKKTWFSIPEKNRPLKGRINLVL | 1216 |

TABLE 6-continued

Human DHFR mutants and novel destabilizing domains

| Mutants | Amino acid Sequence | SEQ ID NO |
|---|---|---|
| | SRELKEPPQGAHFLSRSADDALKLTEQPELANKVDMVW<br>IVGGSSVYKEAMNHPGHLKLFVTRIMQDFESDAFFPEID<br>LEKYKLLPEYPGVLSDVQEEKGIKYKFENYEKND | |
| DHFR (V121A, Y22I) | MVGSLNCIVAVSQNMGIGKNGDLPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSAIKEAMNHPGHLKLFVTRIMQDFESDTFFPEID<br>LEKYKLLPEYPGVLSDVQEEKGIKYKFEVYEKND | 1217 |
| hDHFR (Y122I, A125F) | MVGSLNCIVAVSQNMGIGKNGDLPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSVIKEFMNHPGHLKLFVTRIMQDFESDTFFPEIDL<br>EKYKLLPEYPGVLSDVQEEKGIKYKFEVYEKND | 1218 |
| hDHFR (H131R, E144G) | MVGSLNCIVAVSQNMGIGKNGDLPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSVYKEAMNHPGRLKLFVTRIMQDFGSDTFFPEID<br>LEKYKLLPEYPGVLSDVQEEKGIKYKFENYEKND | 1219 |
| hDHFR (T137R, F143L) | MVGSLNCIVAVSQNMGIGKNGDLPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSVYKEAMNHPGHLKLFVRRIMQDLESDTFFPEID<br>LEKYKLLPEYPGVLSDVQEEKGIKYKFENYEKND | 1220 |
| hDHFR (Y178H, E181G) | MVGSLNCIVAVSQNMGIGKNGDLPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSVYKEAMNHPGHLKLFVTRIMQDFESDTFFPEID<br>LEKYKLLPEYPGVLSDVQEEKGIKHKFGVYEKND | 1221 |
| hDHFR (Y183H, K185E) | MVGSLNCIVAVSQNMGIGKNGDLPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSVYKEAMNHPGHLKLFVTRIMQDFESDTFFPEID<br>LEKYKLLPEYPGVLSDVQEEKGIKYKFEVHEEND | 1222 |
| hDHFR (V9A, S93R, P150L) | MVGSLNCIAAVSQNMGIGKNGDLPWPPLRNEFRYFQR<br>MTTTSSVEGKQNLVIMGKKTWFSIPEKNRPLKGRINLVL<br>SRELKEPPQGAHFLSRRLDDALKLTEQPELANKVDMVW<br>IVGGSSVYKEAMNHPGHLKLFVTRIMQDFESDTFFLEID<br>LEKYKLLPEYPGVLSDVQEEKGIKYKFENYEKND | 1223 |
| hDHFR (I8V, K133E, Y163C) | MVGSLNCVVAVSQNMGIGKNGDLPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSVYKEAMNHPGHLELFVTRIMQDFESDTFFPEID<br>LEKYKLLPECPGVLSDVQEEKGIKYKFEVYEKND | 1224 |
| hDHFR (L23S, V121A, Y157C) | MVGSLNCIVAVSQNMGIGKNGDSPWPPLRNEFRYFQR<br>MTTTSSVEGKQNLVIMGKKTWFSIPEKNRPLKGRINLVL<br>SRELKEPPQGAHFLSRSLDDALKLTEQPELANKVDMVW<br>IVGGSSAYKEAMNHPGHLKLFVTRIMQDFESDTFFPEID<br>LEKCKLLPEYPGVLSDVQEEKGIKYKFEVYEKND | 1225 |
| hDHFR (K19E, F89L, E181G) | MVGSLNCIVAVSQNMGIGENGDLPWPPLRNEFRYFQRM<br>TTTSSVEGKQNLVIMGKKTWFSIPEKNRPLKGRINLVLS<br>RELKEPPQGAHLLSRSLDDALKLTEQPELANKVDMVWI<br>VGGSSVYKEAMNHPGHLKLFVTRIMQDFESDTFFPEIDL<br>EKYKLLPEYPGVLSDVQEEKGIKYKFGVYEKND | 1226 |
| hDHFR (Q36F, N65F, Y122I) | MVGSLNCIVAVSQNMGIGKNGDLPWPPLRNEFRYFFRM<br>TTTSSVEGKQNLVIMGKKTWFSIPEKFRPLKGRINLVLS<br>RELKEPPQGAHFLSRSLDDALKLTEQPELANKVDMVWI<br>VGGSSVIKEAMNHPGHLKLFVTRIMQDFESDTFFPEIDL<br>EKYKLLPEYPGVLSDVQEEKGIKYKFEVYEKND | 1227 |
| hDHFR (G54R, M140V, S168C) | MVGSLNCIVAVSQNMGIGKNGDLPWPPLRNEFRYFQR<br>MTTTSSVEGKQNLVIMRKKTWFSIPEKNRPLKGRINLVL<br>SRELKEPPQGAHFLSRSLDDALKLTEQPELANKVDMVW<br>IVGGSSVYKEAMNHPGHLKLFVTRIVQDFESDTFFPEIDL<br>EKYKLLPEYPGVLCDVQEEKGIKYKFEVYEKND | 1228 |

TABLE 6-continued

Human DHFR mutants and novel destabilizing domains

| Mutants | Amino acid Sequence | SEQ ID NO |
|---|---|---|
| hDHFR (V110A, V136M, K177R) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKADMVW IVGGSSVYKEAMNHPGHLKLFMTRIMQDFESDTFFPEID LEKYKLLPEYPGVLSDVQEEKGIRYKFEVYEKND | 1229 |
| hDHFR (Amino acid 2-187 of WT; Q36F, Y122I, A125F) | VGSLNCIVAVSQNMGIGKNGDLPWPPLRNEFRYFFRMT TTSSVEGKQNLVIMGKKTWFSIPEKNRPLKGRINLVLSR ELKEPPQGAHFLSRSLDDALKLTEQPELANKVDMVWIV GGSSVIKEFMNHPGHLKLFVTRIMQDFESDTFFPEIDLEK YKLLPEYPGVLSDVQEEKGIKYKFEVYEKND | 1230 |
| hDHFR (N49D, F59S, D153G) | MVGSLNCIVAVSQNMGIGKNGDLPWPPLRNEFRYFQR MTTTSSVEGKQDLVIMGKKTWSSIPEKNRPLKGRINLVL SRELKEPPQGAHFLSRSLDDALKLTEQPELANKVDMVW IVGGSSVYKEAMNHPGHLKLFVTRIMQDFESDTFFPEIG LEKYKLLPEYPGVLSDVQEEKGIKYKFEVYEKND | 1231 |
| hDHFR (G21E, I72V, I176T) | MVGSLNCIVAVSQNMGIGKNEDLPWPPLRNEFRYFQRM TTTSSVEGKQNLVIMGKKTWFSIPEKNRPLKGRVNLVLS RELKEPPQGAHFLSRSLDDALKLTEQPELANKVDMVWI VGGSSVYKEAMNHPGHLKLFVTRIMQDFESDTFFPEIDL EKYKLLPEYPGVLSDVQEEKGTKYKFEVYEKND | 1232 |
| hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKPTGRSGLADKVDMAR IVGGSSVCKEAIRYPGHPKLPVTRTMQDFESDTSLPEVA LEKYKLLPEYPGVLSGAQEEKGARYKFEAYERSD | 1233 |
| hDHFR (V2A, R33G, Q36R, L100P, K185R) | MAGSLNCIVAVSQNMGIGKNGDLPWPPLRNEFGYFRR MTTTSSVEGKQNLVIMGKKTWFSIPEKNRPLKGRINLVL SRELKEPPQGAHFLSRSLDDALKPTEQPELANKVDMVW IVGGSSVYKEAMNHPGHLKLFVTRIMQDFESDTFFPEID LEKYKLLPEYPGVLSDVQEEKGIKYKFEVYERND | 1234 |
| hDHFR (G16S, I17V, F89L, D96G, K123E, M140V, D146G, K156R) | MVGSLNCIVAVSQNMSVGKNGDLPWPPLRNEFRYFQR MTTTSSVEGKQNLVIMGKKTWFSIPEKNRPLKGRINLVL SRELKEPPQGAHLLSRSLDGALKLTEQPELANKVDMVW IVGGSSVYEEAMNHPGHLKLFVTRIVQDFESGTFFPEIDL ERYKLLPEYPGVLSDVQEEKGIKYKFEVYEKND | 1235 |
| hDHFR (F35L, R37G, N65A, L68P, K69E, R71G, L80P, K99G, G117D, L132P, I139V, M140I, D142G, D146G, E173G, D187G) | MVGSLNCIVAVSQNMGIGKNGDLPWPPLRNEFRYLQG MTTTSSVEGKQNLVIMGKKTWFSIPEKARPSEGGINLVL SREPKEPPQGAHFLSRSLDDALGLTEQPELANKVDMVW IVDGSSVYKEAMNHPGHPKLFVTRVIQGFESGTFFPEIDL EKYKLLPEYPGVLSDVQEGKGIKYKFEVYEKNG | 1236 |
| hDHFR (I17N, L98S, K99R, M112T, E151G, E162G, E172G) | MVGSLNCIVAVSQNMGNGKNGDLPWPPLRNEFRYFQR MTTTSSVEGKQNLVIMGKKTWFSIPEKNRPLKGRINLVL SRELKEPPQGAHFLSRSLDDASRLIEQPELANKVDTVWI VGGSSVYKEAMNHPGHLKLFVTRIMQDFESDTFFPGIDL EKYKLLPGYPGVLSDVQGEKGIKYKFEVYEKND | 1237 |
| hDHFR (R138G, D142G, F143S, K156R, K158E, E162G, V166A, K177E, Y178C, K185E, N186S) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMNHPGHLKLFVTGIMQGSESDTFFPEID LERYELLPGYPGALSDVQEEKGIECKFEVYEESD | 1238 |
| hDHFR (K81R, K99R, L100P, E102G, N108D, K123R, H128R, D142G, F180L, K185E) | MVGSLNCIVAVSQNMGIGKNGDLPWPPLRNEFRYFQR MTTTSSVEGKQNLVIMGKKTWFSIPEKNRPLKGRINLVL SRELREPPQGAHFLSRSLDDALRPTGQPELADKVDMVW IVGGSSVYREAMNRPGHLKLFVTRIMQGFESDTFFPEID LEKYKLLPEYPGVLSDVQEEKGIKYKLEVYEEND | 1239 |
| hDHFR (N14S, P24S, F35L, M53T, K56E, R92G, S93G, N127S, H128Y, F135L, F143S, L159P, L160P, E173A, F180L) | MVGSLNCIVAVSQSMGIGKNGDLSWPPLRNEFRYLQRM TTTSSVEGKQNLVITGKETWFSIPEKNRPLKGRINLVLSR ELKEPPQGAHFLSGGLDDALKLTEQPELANKVDMVWIV GGSSVYKEAMSYPGHLKLLVTRIMQDSESDTFFPEIDLE KYKPPPEYPGVLSDVQEAKGIKYKLEVYEKND | 1240 |

TABLE 6-continued

Human DHFR mutants and novel destabilizing domains

| Mutants | Amino acid Sequence | SEQ ID NO |
|---|---|---|
| hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S) | MAGSLNCIVAVSQNMGVGKNGDLPWPPLRDGFRYFRR MTTTSSVEGKQNLVIMGKKTWSSIPEKNRPLEGRTNLV LSRELKEPPQGAYLLSRSLDDALKTEQPELADEAGMV WVVGGSSVDKEAMNHPGHPKLSVTRIVQDFGSDAFFPE IDLEKCKLLPEYPGVLSDAQEERGIKYKFEVYEKSD | 1241 |
| hDHFR (L28P, N30H, M38V, V44A, L68S, N73G, R78G, A97T, K99R, A107T, K109R, D111N, L134P, F135V, T147A, I152V, K158R, E172G, V182A, E184R) | MVGSLNCIVAVSQNMGIGKNGDLPWPPPRHEFRYFQRV TTTSSAEGKQNLVIMGKKTWFSIPEKNRPSKGRIGLVLS GELKEPPQGAHFLSRSLDDTLRLTEQPELTNRVNMVWI VGGSSVYKEAMNHPGHLRPVVTRIMQDFESDAFFPEVD LEKYRLLPEYPGVLSDVQGEKGIKYKFEAYRKND | 1242 |
| hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N) | MVGSLNCIVTVSRSMGIGKDGDLSWPPLRSEFRYFQRTT ATSSVEGRQSLVIMGKRTWFSTPERNRPLRGRANLVLS GELKGPPQGAHLLSRSLDGALKLTEQPELADKVDVVRI VGGSSVDEEAMNHPGHLKLFVTRVMRGFESDTLFPGID LGKRKLLPEYPGVLSDVREEKGIKYKLEVCGNN | 1243 |
| hDHFR (Amino acid 2-187 of WT; I17V, Y122I) | VGSLNCIVAVSQNMGVGKNGDLPWPPLRNEFRYFQRM TTTSSVEGKQNLVIMGKKTWFSIPEKNRPLKGRINLVLS RELKEPPQGAHFLSRSLDDALKTEQPELANKVDMVWI VGGSSVIKEAMNHPGHLKLFVTRIMQDFESDTFFPEIDL EKYKLLPEYPGVLSDVQEEKGIKYKFEVYEKND | 1244 |
| hDHFR (Amino acid 2-187 of WT; Y122I, M140I) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVIKEAMNHPGHLKLFVTRIIQDFESDTFFPEIDLEK YKLLPEYPGVLSDVQEEKGIKYKFEVYEKND | 1245 |
| hDHFR (Amino acid 2-187 of WT; N127Y, Y122I) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVIKEAMYHPGHLKLFVTRIMQDFESDTFFPEIDLE KYKLLPEYPGVLSDVQEEKGIKYKFEVYEKND | 1246 |
| hDHFR (Amino acid 2-187 of WT; Y122I, H131R, E144G) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVIKEAMNHPGRLKLFVTRIMQDFGSDTFFPEIDLE KYKLLPEYPGVLSDVQEEKGIKYKFEVYEKND | 1196 |
| hDHFR (Amino acid 2-187 of WT; D22S, F32M, R33S, Q36S, N65S) | VGSLNCIVAVSQNMGIGKNGSLPWPPLRNEMSYFSRMT TTSSVEGKQNLVIMGKKTWFSIPEKSRPLKGRINLVLSR ELKEPPQGAHFLSRSLDDALKLTEQPELANKVDMVWIV GGSSVYKEAMNHPGHLKLFVTRIMQDFESDTFFPEIDLE KYKLLPEYPGVLSDVQEEKGIKYKFEVYEKND | 1248 |
| hDHFR (Amino acid 2-187 of WT; E31D, F32M, V116I) | VGSLNCIVAVSQNMGIGKNGDLPWPPLRNDMRYFQRM TTTSSVEGKQNLVIMGKKTWFSIPEKNRPLKGRINLVLS RELKEPPQGAHFLSRSLDDALKLTEQPELANKVDMVWII GGSSVYKEAMNHPGHLKLFVTRIMQDFESDTFFPEIDLE KYKLLPEYPGVLSDVQEEKGIKYKFEVYEKND | 1249 |
| hDHFR (Amino acid 2-187 of WT; E162G, I176F) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVYKEAMNHPGHLKLFVTRIMQDFESDTFFPEIDLE KYKLLPGYPGVLSDVQEEKGFKYKFEVYEKND | 1250 |
| hDHFR (Amino acid 2-187 of WT; K185E) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVYKEAMNHPGHLKLFVTRIMQDFESDTFFPEIDLE KYKLLPEYPGVLSDVQEEKGIKYKFEVYEEND | 1251 |

TABLE 6-continued

Human DHFR mutants and novel destabilizing domains

| Mutants | Amino acid Sequence | SEQ ID NO |
|---|---|---|
| hDHFR (Amino acid 2-187 of WT; Y122I, A125F) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVIKEFMNHPGHLKLFVTRIMQDFESDTFFPEIDLEK YKLLPEYPGVLSDVQEEKGIKYKFEVYEKND | 1252 |
| hDHFR (Amino acid 2-187 of WT; Q36F, N65F, Y122I) | VGSLNCIVAVSQNMGIGKNGDLPWPPLRNEFRYFFRMT TTSSVEGKQNLVIMGKKTWFSIPEKFRPLKGRINLVLSR ELKEPPQGAHFLSRSLDDALKLTEQPELANKVDMVWIV GGSSVIKEAMNHPGHLKLFVTRIMQDFESDTFFPEIDLE KYKLLPEYPGVLSDVQEEKGIKYKFEVYEKND | 1253 |
| hDHFR (Amino acid 2-187 of WT; N127Y) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVYKEAMYHPGHLKLFVTRIMQDFESDTFFPEIDLE KYKLLPEYPGVLSDVQEEKGIKYKFEVYEKND | 1254 |
| hDHFR (Amino acid 2-187 of WT; H131R, E144G) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVYKEAMNHPGRLKLFVTRIMQDFGSDTFFPEIDLE KYKLLPEYPGVLSDVQEEKGIKYKFEVYEKND | 1255 |
| hDHFR (Amino acid 2-187 of WT; I17V) | VGSLNCIVAVSQNMGVGKNGDLPWPPLRNEFRYFQRM TTTSSVEGKQNLVIMGKKTWFSIPEKNRPLKGRINLVLS RELKEPPQGAHFLSRSLDDALKLTEQPELANKVDMVWI VGGSSVYKEAMNHPGHLKLFVTRIMQDFESDTFFPEIDL EKYKLLPEYPGVLSDVQEEKGIKYKFEVYEKND | 1256 |
| hDHFR (Amino acid 2-187 of WT; Y122I) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVIKEAMNHPGHLKLFVTRIMQDFESDTFFPEIDLE KYKLLPEYPGVLSDVQEEKGIKYKFEVYEKND | 1257 |
| hDHFR (E162G, I176F) | MVGSLNCIVAVSQNMGIGKNGDLPWPPLRNEFRYFQR MTTTSSVEGKQNLVIMGKKTWFSIPEKNRPLKGRINLVL SRELKEPPQGAHFLSRSLDDALKLTEQPELANKVDMVW IVGGSSVYKEAMNHPGHLKLFVTRIMQDFESDTFFPEID LEKYKLLPGYPGVLSDVQEEKGFKYKFEVYEKND | 1258 |
| hDHFR (Amino acid 2-187 of WT; Q36K, Y122I) | VGSLNCIVAVSQNMGIGKNGDLPWPPLRNEFRYFKRMT TTSSVEGKQNLVIMGKKTWFSIPEKNRPLKGRINLVLSR ELKEPPQGAHFLSRSLDDALKLTEQPELANKVDMVWIV GGSSVIKEAMNHPGHLKLFVTRIMQDFESDTFFPEIDLE KYKLLPEYPGVLSDVQEEKGIKYKFEVYEKND | 1259 |

In one embodiment, the stimulus is a small molecule that binds to a SRE to post-translationally regulate protein levels. In one aspect, DHFR ligands: trimethoprim (TMP) and methotrexate (MTX) are used to stabilize hDHFR mutants. The hDHFR based destabilizing domains are listed in Table 6. The position of the mutated amino acid listed in Table 6 is relative to the human DHFR (Uniprot ID: P00374) of SEQ. ID NO. 712 4318 for human DHFR. In Table 6, "del" means that the mutation is the deletion of the amino acid at that position relative to the wild type sequence.

In some embodiments, DD mutations that do not inhibit ligand binding may be preferentially selected. In some embodiments, ligand binding may be improved by mutation of residues in DHFR. Amino acid positions selected for mutation include aspartic acid at position 22 of SEQ ID NO. 4317, glutamic acid at position 31 of SEQ ID NO. 4317; phenyl alanine at position 32 of SEQ ID NO. 4317; arginine at position 33 of SEQ ID NO. 4317; glutamine at position 36 of SEQ ID NO. 4317; asparagine at position 65 of SEQ ID NO. 4317; and valine at position 115 of SEQ ID NO. 4317.

In some embodiments, one or more of the following mutations may be utilized in the DDs of the present invention to improve TMP binding, including but not limited to, D22S, E31D, F32M, R33S, Q36F, N65S, and V116I. The position of the mutated amino acids is relative to the wildtype human DHFR (Uniprot ID: P00374) of SEQ ID NO. 4317.

In some embodiments, novel DDs derived from human DHFR may include one, two, three, four, five or more mutations including, but not limited to, M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In some embodiments, novel DDs derived from human DHFR may comprise amino acids 2-187 of the wild type human DHFR sequence. This may be referred to as an M1del mutation.

In some embodiments, novel DDs derived from human DHFR may comprise amino acids 2-187 of the wild type human DHFR sequence (also referred to as an M1del mutation), and may include one, two, three, four, five or more mutations including, but not limited to, M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In some embodiments, the DD mutations identified herein, may be mapped to the DHFR sequence to identify mutational hotspots. The DD characteristics may be improved by mutating the amino acids at the hotspot position to any of the known amino acids, including, but not limited to lysine, aspartic acid, glutamic acid, glutamine, asparagine, histidine, serine, threonine, tyrosine, cysteine, methionine, tryptophan, alanine, isoleucine, leucine, phenylalanine, valine, proline, and glycine. In some instances, a library of hotspot mutations may be generated by site directed mutagenesis and each of the mutants in the library is fused to a reporter protein e.g. AcGFP or luciferase via a linker. The properties of the DDs may be analyzed in the presence and absence of ligands such as TMP and MTX. In some embodiments, variant libraries may be generated by methods known in the art. In one embodiment, VariantFind™ may be used to generate variant library. The VariantFind™ platform is a series of multiplex PCRs that mutates multiple amino acid positions simultaneously. Desired mutations are directly encoded by oligonucleotides, providing high control and specificity during the mutagenesis process. These oligonucleotides are combined in a series of sequential PCRs that result in a ready-to-clone DNA library encoding all desired mutations. In one embodiment, any of the codons in the polynucleotides of the invention may be altered by saturation mutagenesis. In another embodiment, a ruleset for amino acid changes may be used to mutate select amino acids of the DDs. In one embodiment, the rule may be the mutation of all Arginine residues in the DD to alanine, lysine and/or leucine. In other embodiments, all phenyl alanine residues in the DD may be mutated to alanine, leucine and/or threonine.

The destabilization domains described herein may also include amino acid and nucleotide substitutions that do not affect stability, including conservative, non-conservative substitutions and or polymorphisms.

The PEKN (SEQ ID NO. 1260) sequence that spans from 61-65 amino acids from SEQ ID NO. 1 may be deleted or mutated to alternate amino acids. Comparison of human DHFR sequence with folate reductases of other species has revealed that the "PEKN" (SEQ ID NO. 1260) insertion found in human DHFR serves as a lid over the substrate Dihydrofolate site and is a major determinant blocking interaction of the human DHFR with DHFR inhibitors with specificity to parasitic and bacterial DHFR. Comparative analysis of the dihydrofolate reductase of *Mycobacterium tuberculosis* and human DHFR revealed that the hDHFR lacks a glycerol (GOL) binding site. The lack of GOL binding site prevents binding with bacterial DHFR inhibitors. In some embodiments, the amino acids equivalent to position tryptophan at position 22, leucine at position 24, aspartic acid at position 27, and glutamine at position 28 of DHFR of *M. tuberculosis* are inserted into the human DHFR.

In some embodiments, DD mutations that do not inhibit ligand binding may be preferentially selected. In some embodiments, ligand binding may be improved by mutation of residues in DHFR. Amino acid positions selected for mutation include aspartic acid at position 22 of SEQ ID NO. 1, glutamic acid at position 31 of SEQ ID NO. 1; phenyl alanine at position 32 of SEQ ID NO. 1; arginine at position 33 of SEQ ID NO. 1; glutamine at position 36 of SEQ ID NO. 1; asparagine at position 65 of SEQ ID NO. 1; and valine at position 115 of SEQ ID NO. 1. In some embodiments, one or more of the following mutations may be utilized in the DDs of the present invention to improve TMP binding, including but not limited to, D22S, E31D, F32M, R33S, Q36S, N65S, and V116I. Exemplary DDs that may be tested for improved ligand binding properties include but are not limited to hDHFR (D22S, F32M, R33S, Q36S, N65S) (SEQ ID NO. 4319 (amino acid 2-187 of WT, D22S, F32M, R33S, Q36S, N65S) (encoded by SEQ ID NO. 4320) or SEQ ID NO. 4321 (D22S, F32M, R33S, Q36S, N65S) (encoded by SEQ ID NO. 4322)) and hDHFR (E31D, F32M, V116I) (SEQ ID NO. 4323 (amino acid 2-187 of WT, E31D, F32M, V116I) (encoded by SEQ ID NO. 4324) or SEQ ID NO. 4325 (E31D, F32M, V116I) (encoded by SEQ ID NO. 4326)). The position of the mutated amino acids is relative to the wildtype human DHFR (Uniprot ID: P00374) of SEQ ID NO. 1.

In some embodiments, novel DDs derived from human DHFR may include one, two, three, four, five or more mutations including, but not limited to, M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In some embodiments, novel DDs derived from human DHFR may comprise amino acids 2-187 of the wild type human DHFR sequence. This may be referred to as an M1del mutation.

In some embodiments, novel DDs derived from human DHFR may comprise amino acids 2-187 of the wild type human DHFR sequence (also referred to as an M1del mutation), and may include one, two, three, four, five or more mutations including, but not limited to, M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

Newly identified hDHFR mutants are fused to reporter proteins e.g. AcGFP (SEQ ID NO. 4327) and luciferase (SEQ ID NO. 4328, encoded by SEQ ID NO. 4329) through a linker sequence GGSGGGSGG (SEQ ID NO. 3038), GS, SG or GGSGGG (SEQ ID NO. 4330) at either the N-terminal or the C-terminal end of the fusion constructs and cloned into pLVX-IRES-puro vectors. The destabilizing and ligand dependent stabilization properties of the fusion proteins may be evaluated by methods such as western blotting, and FACS. hDHFR mutant fusion constructs are described in Table 7. The amino acid sequences in Table 7 may comprise a stop codon which is denoted in the table with a "*" at the end of the amino acid sequence. The position of the mutated amino acids listed in Table 7 is relative to the wildtype human DHFR (Uniprot ID: P00374) of SEQ ID NO. 1. In Table 7, "del" means that the mutation is the deletion of the amino acid at that position relative to the wild type sequence.

TABLE 7

N terminal and C terminal hDHFR-GFP fusion constructs

| Construct ID | Description | AA Sequence | Amino Acid SEQ ID NO | Nucleic Acid SEQ ID NO |
|---|---|---|---|---|
| OT-hDHFR-001 (OT-hDHFRN-001) | hDHFR (WT); Restriction site (TS); Linker (GGSGGG (SEQ ID NO: 2728)); AcGFP; stop | MVGSLNCIVAVSQNMGIGKNGDLPWPPLRNEFRYF QRMTTTSSVEGKQNLVIMGKKTWFSIPEKNRPLKG RINLVLSRELKEPPQGAHFLSRSLDDALKLTEQPEL ANKVDMVWIVGGSSVYKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 2738 | 4331 |
| OT-hDHFR-002 (OT-hDHFRN-002) | hDHFR (Y122I); Restriction site (TS); Linker (GGSGGG (SEQ ID NO: 2728)); AcGFP; stop | MVGSLNCIVAVSQNMGIGKNGDLPWPPLRNEFRYF QRMTTTSSVEGKQNLVIMGKKTWFSIPEKNRPLKG RINLVLSRELKEPPQGAHFLSRSLDDALKLTEQPEL ANKVDMVWIVGGSSVIKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1263 | 4332 |

TABLE 7-continued

N terminal and C terminal hDHFR-GFP fusion constructs

| Construct ID | Description | AA Sequence | Amino Acid SEQ ID NO | Nucleic Acid SEQ ID NO |
|---|---|---|---|---|
| OT-hDHFR-003 (OT-hDHFRN-003) | hDHFR (M53T, R138I); Restriction site (TS); Linker (GGSGGG (SEQ ID NO: 2728)); AcGFP; stop | MVGSLNCIVAVSQNMGIGKNGDLPWPPLRNEFRYF QRMTTTSSVEGKQNLVITGKKTWFSIPEKNRPLKG RINLVLSRELKEPPQGAHFLSRSLDDALKLTEQPEL ANKVDMVWIVGGSSVYKEAMNHPGHLKLFVTIIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1264 | 4333 |
| OT-hDHFR-004 (OT-hDHFRN-004) | hDHFR (V75F, Y122I); Restriction site (TS); Linker (GGSGGG (SEQ ID NO: 2728)); AcGFP; stop | MVGSLNCIVAVSQNMGIGKNGDLPWPPLRNEFRYF QRMTTTSSVEGKQNLVIMGKKTWFSIPEKNRPLKG RINLFLSRELKEPPQGAHFLSRSLDDALKLTEQPEL ANKVDMVWIVGGSSVIKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1265 | 4334 |
| OT-hDHFR-005 (OT-hDHFRN-005) | hDHFR (A125F, Y122I); Restriction site (TS); Linker (GGSGGG (SEQ ID NO: 2728)); AcGFP; stop | MVGSLNCIVAVSQNMGIGKNGDLPWPPLRNEFRYF QRMTTTSSVEGKQNLVIMGKKTWFSIPEKNRPLKG RINLVLSRELKEPPQGAHFLSRSLDDALKLTEQPEL ANKVDMVWIVGGSSVIKEFMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1266 | 4335 |
| OT-hDHFR-006 (OT-hDHFRN-006) | hDHFR (L74N, Y122I); Restriction site (TS); Linker (GGSGGG (SEQ ID NO: 2728)); AcGFP; stop | MVGSLNCIVAVSQNMGIGKNGDLPWPPLRNEFRYF QRMTTTSSVEGKQNLVIMGKKTWFSIPEKNRPLKG RINNVLSRELKEPPQGAHFLSRSLDDALKLTEQPEL ANKVDMVWIVGGSSVIKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1267 | 4336 |
| OT-hDHFR-007 (OT-hDHFRN-007) | hDHFR (L94A, T147A); Restriction site (TS); Linker (GGSGGG (SEQ ID NO: 2728)); stop | MVGSLNCIVAVSQNMGIGKNGDLPWPPLRNEFRYF QRMTTTSSVEGKQNLVIMGKKTWFSIPEKNRPLKG RINLVLSRELKEPPQGAHFLSRSADDALKLTEQPEL ANKVDMVWIVGGSSVYKEAMNHPGHLKLFVTRIM QDFESDAFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1268 | 4337 |

TABLE 7-continued

N terminal and C terminal hDHFR-GFP fusion constructs

| Construct ID | Description | AA Sequence | Amino Acid SEQ ID NO | Nucleic Acid SEQ ID NO |
|---|---|---|---|---|
| OT-hDHFR-008 (OT-hDHFRN-008) | hDHFR (G21T, Y122I); Restriction site (TS); Linker (GGSGGG (SEQ ID NO: 2728)); AcGFP; stop | MVGSLNCIVAVSQNMGIGKNTDLPWPPLRNEFRYF QRMTTTSSVEGKQNLVIMGKKTWFSIPEKNRPLKG RINLVLSRELKEPPQGAHFLSRSLDDALKLTEQPEL ANKVDMVWIVGGSSVIKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1269 | 4338 |
| OT-hDHFR-009 (OT-hDHFRN-009) | hDHFR (Q36K, Y122I); Restriction site (TS); Linker (GGSGGG (SEQ ID NO: 2728)); AcGFP; stop | MVGSLNCIVAVSQNMGIGKNGDLPWPPLRNEFRYF KRMTTTSSVEGKQNLVIMGKKTWFSIPEKNRPLKG RINLVLSRELKEPPQGAHFLSRSLDDALKLTEQPEL ANKVDMVWIVGGSSVIKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1270 | 4339 |
| OT-hDHFR-010 (OT-hDHFRN-010) | hDHFR (Q36F, N65F, Y122I); Restriction site (TS); Linker (GGSGGG (SEQ ID NO: 2728)); AcGFP; stop | MVGSLNCIVAVSQNMGIGKNGDLPWPPLRNEFRYF KRMTTTSSVEGKQNLVIMGKKTWFSIPEKFRPLKG RINLVLSRELKEPPQGAHFLSRSLDDALKLTEQPEL ANKVDMVWIVGGSSVIKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1271 | 4340 |
| OT-hDHFR-021 (OT-hDHFRN-021) | AcGFP; Restriction site (TS); Linker (GGSGGG (SEQ ID NO: 2728)); hDHFR (Q36K, Y122I); stop | MVGSLNCIVAVSQNMGIGKNGDLPWPPLRNEFRYF QRMTTTSSVEGKQNLVIMGKKTWFSIPEKNRPLKG RINLVLSRELKEPPQGAHFLSRSLDDALKLTEQPEL ANKVDMVWIVGGSSAIKEAMNHPGHLKLFVTRIM QDFESDTFFPEIDLEKYKLLPEYPGVLSDVQEEKGI KYKFEVYEKNDTSGGSGGGMVSKGAELFTGIVPILI ELNGDVNGHKFSVSGEGEGDATYGKLTLKFICTTG KLPVPWPTLVTTLSYGVQCFSRYPDHMKQHDFFKS AMPEGYIQERTIFFEDDGNYKSRAEVKFEGDTLVN RIELTGTDFKEDGNILGNKMEYNYNAHNVYIMTDK AKNGIKVNFKIRHNIEDGSVQLADHYQQNTPIGDG PVLLPDNHYLSTQSALSKDPNEKRDHMIYFGFVTA AAITHGMDELYK* | 1272 | 4341 |
| OT-hDHFR-011 (OT-hDHFRC-011) | AcGFP; Linker (GGSGGG (SEQ ID NO: 2728)); Restriction site (TS); hDHFR (amino acid 2-187 of WT); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSVYKEAMNHPGHLKLFVTRI MQDFESDTFFPEIDLEKYKLLPEYPGVLSDVQEEKG IKYKFEVYEKND* | 1187 | 4342 |

TABLE 7-continued

N terminal and C terminal hDHFR-GFP fusion constructs

| Construct ID | Description | AA Sequence | Amino Acid SEQ ID NO | Nucleic Acid SEQ ID NO |
|---|---|---|---|---|
| OT-hDHFR-012 (OT-hDHFRC-012) | AcGFP; Linker (GGSGGG (SEQ ID NO: 2728)); Restriction site (TS); hDHFR (Amino acid 2-187 of WT) (Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSVIKEAMNHPGHLKLFVTRI MQDFESDTFFPEIDLEKYKLLPEYPGVLSDVQEEKG IKYKFEVYEKND* | 1273 | 4343 |
| OT-hDHFR-013 (OT-hDHFRC-013) | AcGFP; Linker (GGSGGG (SEQ ID NO: 2728)); Restriction site (TS); hDHFR (Amino acid 2-187 of WT) (M53T, R138I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVITGKKTWFSIPEKNRPLKG RINLVLSRELKEPPQGAHFLSRSLDDALKLTEQPEL ANKVDMVWIVGGSSVYKEAMNHPGHLKLFVTIIM QDFESDTFFPEIDLEKYKLLPEYPGVLSDVQEEKGI KYKFEVYEKND* | 1274 | 4344 |
| OT-hDHFR-014 (OT-hDHFRC-014) | AcGFP; Linker (GGSGGG (SEQ ID NO: 2728)); Restriction site (TS); hDHFR (Amino acid 2-187 of WT) (V75F, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLFLSRELKEPPQGAHFLSRSLDDALKLTEQPE LANKVDMVWIVGGSSVIKEAMNHPGHLKLFVTRI MQDFESDTFFPEIDLEKYKLLPEYPGVLSDVQEEKG IKYKFEVYEKND* | 1275 | 4345 |
| OT-hDHFR-015 (OT-hDHFRC-015) | AcGFP; Linker (GGSGGG (SEQ ID NO: 2728)); Restriction site (TS); hDHFR (Amino acid 2-187 of WT) (A125F, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSVIKEFMNHPGHLKLFVTRI MQDFESDTFFPEIDLEKYKLLPEYPGVLSDVQEEKG IKYKFEVYEKND* | 1276 | 4346 |
| OT-hDHFR-016 (OT-hDHFRC-016) | AcGFP; Linker (GGSGGG (SEQ ID NO: 2728)); Restriction site (TS); hDHFR (Amino acid 2-187 of WT) (L74N, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINNVLSRELKEPPQGAHFLSRSLDDALKLTEQPE LANKVDMVWIVGGSSVIKEAMNHPGHLKLFVTRI MQDFESDTFFPEIDLEKYKLLPEYPGVLSDVQEEKG IKYKFEVYEKND* | 1277 | 4347 |

TABLE 7-continued

N terminal and C terminal hDHFR-GFP fusion constructs

| Construct ID | Description | AA Sequence | Amino Acid SEQ ID NO | Nucleic Acid SEQ ID NO |
|---|---|---|---|---|
| OT-hDHFR-017 (OT-hDHFRC-Y017) | AcGFP; Linker (GGSGGG (SEQ ID NO: 2728)); Restriction site (TS); hDHFR (Amino acid 2-187 of WT) (L94A, T147A); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN KSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSADDALKLTEQPE LANKVDMVWIVGGSSVYKEAMNHPGHLKLFVTRI MQDFESDAFFPEIDLEKYKLLPEYPGVLSDVQEEKG IKYKFEVYEKND* | 1278 | 4348 |
| OT-hDHFR-018 (OT-hDHFRC-018) | AcGFP; Linker (GGSGGG (SEQ ID NO: 2728)); Restriction site (TS); hDHFR (Amino acid 2-187 of WT) (G21T, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNTDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSVIKEAMNHPGHLKLFVTRI MQDFESDTFFPEIDLEKYKLLPEYPGVLSDVQEEKG IKYKFEVYEKND* | 1279 | 4349 |
| OT-hDHFR-019 (OT-hDHFRC-019) | AcGFP; Linker (GGSGGG (SEQ ID NO: 2728)); Restriction site (TS); hDHFR (Amino acid 2-187 of WT) (Q36K, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FKRMTTTSSVEGKQNLVIMGKKTWFSIPEKNRPLK GRINLVLSRELKEPPQGAHFLSRSLDDALKLTEQPE LANKVDMVWIVGGSSVIKEAMNHPGHLKLFVTRI MQDFESDTFFPEIDLEKYKLLPEYPGVLSDVQEEKG IKYKFEVYEKND* | 1280 | 4350 |
| OT-hDHFR-020 (OT-hDHFRC-020) | AcGFP; Linker (GGSGGG (SEQ ID NO: 2728)); Restriction site (TS); hDHFR (Amino acid 2-187 of WT) (Q36K, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FKRMTTTSSVEGKQNLVIMGKKTWFSIPEKNRPLK GRINLVLSRELKEPPQGAHFLSRSLDDALKLTEQPE LANKVDMVWIVGGSSVIKEAMNHPGHLKLFVTRI MQDFESDTFFPEIDLEKYKLLPEYPGVLSDVQEEKG IKYKFEVYEKND* | 1281 | 4351 |
| OT-hDHFR-022 (OT-hDHFRC-022) | AcGFP; Linker (GGSGGG (SEQ ID NO: 2728)); Restriction site (TS); hDHFR (Amino acid 2-187 of WT) (V121A, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSAIKEAMNHPGHLKLFVTRI MQDFESDTFFPEIDLEKYKLLPEYPGVLSDVQEEKG IKYKFEVYEKND* | 1282 | 4352 |

TABLE 7-continued

N terminal and C terminal hDHFR-GFP fusion constructs

| Construct ID | Description | AA Sequence | Amino Acid SEQ ID NO | Nucleic Acid SEQ ID NO |
|---|---|---|---|---|
| OT-hDHFR-027 (OT-hDHFRC-027) | AcGFP. Linker (GGSGGG (SEQ ID NO: 2728))-Restriction site (TS); hDHFR (Amino acid 2-187 of WT) (D22S, F32M, R33S, Q36S, N65S); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGSLPWPPLRNEMSY FSRMTTTSSVEGKQNLVIMGKKTWFSIPEKSRPLKG RINLVLSRELKEPPQGAHFLSRSLDDALKLTEQPEL ANKVDMVWIVGGSSVYKEAMNHPGHLKLFVTRIM QDFESDTFFPEIDLEKYKLLPEYPGVLSDVQEEKGI KYKFEVYEKND* | 1283 | 4353 |
| OT-hDHFR-028 (OT-hDHFRC-028) | AcGFP; Linker (GGSGGG (SEQ ID NO: 2728))-Restriction site (TS); hDHFR (Amino acid 2-187 of WT) (E31D, F32M, V116I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNDMR YFQRMTTTSSVEGKQNLVIMGKKTWFSIPEKNRPL KGRINLVLSRELKEPPQGAHFLSRSLDDALKLTEQP ELANKVDMVWIIGGSSVYKEAMNHPGHLKLFVTRI MQDFESDTFFPEIDLEKYKLLPEYPGVLSDVQEEKG IKYKFEVYEKND* | 1284 | 4354 |
| OT-hDHFR-029 (OT-hDHFRC-029) | AcGFP; Linker (GGSGGG (SEQ ID NO: 2728))-Restriction site (TS); hDHFR (Amino acid 2-187 of WT) (I17V, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGVGKNGDLPWPPLRNEFR YFQRMTTTSSVEGKQNLVIMGKKTWFSIPEKNRPL KGRINLVLSRELKEPPQGAHFLSRSLDDALKLTEQP ELANKVDMVWIVGGSSVIKEAMNHPGHLKLFVTRI MQDFESDTFFPEIDLEKYKLLPEYPGVLSDVQEEKG IKYKFEVYEKND* | 1285 | 4355 |
| OT-hDHFR-030 (OT-hDHFRC-030) | AcGFP; Linker (GGSGGG (SEQ ID NO: 2728))-Restriction site (TS); hDHFR (Amino acid 2-187 of WT) (Y122I, M140I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSVIKEAMNHPGHLKLFVTRII QDFESDTFFPEIDLEKYKLLPEYPGVLSDVQEEKGI KYKFEVYEKND* | 1286 | 4356 |
| OT-hDHFR-031 (OT-hDHFRC-031) | AcGFP; Linker (GGSGGG (SEQ ID NO: 2728))-Restriction site (TS); hDHFR (Amino acid 2-187 of WT) (N127Y, Y122I); stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSVIKEAMYHPGHLKLFVTRI MQDFESDTFFPEIDLEKYKLLPEYPGVLSDVQEEKG IKYKFEVYEKND* | 1287 | 4357 |

TABLE 7-continued

N terminal and C terminal hDHFR-GFP fusion constructs

| Construct ID | Description | AA Sequence | Amino Acid SEQ ID NO | Nucleic Acid SEQ ID NO |
|---|---|---|---|---|
| OT-hDHFR-032 (OT-hDHFRC-032) | AcGFP; Linker (GGSGGG (SEQ ID NO: 2728))-Restriction site (TS); hDHFR (Amino acid 2-187 of WT) (Y122I, H131R, E144G) ; stop | MVSKGAELFTGIVPILIELNGDVNGHKFSVSGEGEG DATYGKLTLKFICTTGKLPVPWPTLVTTLSYGVQC FSRYPDHMKQHDFFKSAMPEGYIQERTIFFEDDGN YKSRAEVKFEGDTLVNRIELTGTDFKEDGNILGNK MEYNYNAHNVYIMTDKAKNGIKVNFKIRHNIEDGS VQLADHYQQNTPIGDGPVLLPDNHYLSTQSALSKD PNEKRDHMIYFGFVTAAAITHGMDELYKGGSGGG TSVGSLNCIVAVSQNMGIGKNGDLPWPPLRNEFRY FQRMTTTSSVEGKQNLVIMGKKTWFSIPEKNRPLK GRINLVLSRELKEPPQGAHFLSRSLDDALKLTEQPE LANKVDMVWIVGGSSVIKEAMNHPGRLKLFVTRI MQDFGSDTFFPEIDLEKYKLLPEYPGVLSDVQEEKG IKYKFEVYEKND* | 1288 | 4358 |
| OT-hDHFR-023 | Luc2p-Linker (SG)-DHFR (Amino acid 2-187 of WT) (N186D); stop | MEDAKNIKKGPAPFYPLEDGTAGEQLHKAMKRYA LVPGTIAFTDAHIEVDITYAEYFEMSVRLAEAMKR YGLNTNHRIVVCSENSLQFFMPVLGALFIGVAVAP ANDIYNERELLNSMGISQPTVVFVSKKGLQKILNVQ KKLPIIQKIIIMDSKTDYQGFQSMYTFVTSHLPPGFN EYDFVPESFDRDKTIALIMNSSGSTGLPKGVALPHR TACVRFSHARDPIFGNQIIPDTAILSVVPFHHGFGMF TTLGYLICGFRVVLMYRFEEELFLRSLQDYKIQSAL LVPTLFSFFAKSTLIDKYDLSNLHEIASGGAPLSKEV GEAVAKRFHLPGIRQGYGLTETTSAILITPEGDDKP GAVGKVVPFFEAKVVDLDTGKTLGVNQRGELCVR GPMIMSGYVNNPEATNALIDKDWLHSGDIAYWD EDEHFFIVDRLKSLIKYKGYQVAPAELESILLQHPNI FDAGVAGLPDDDAGELPAAVVVLEHGKTMTEKEI VDYVASQVTTAKKLRGGVVFVDEVPKGLTGKLDA RKIREILIKAKKGGKIAVSGVGSLNCIVAVSQNMGI GKNGDLPWPPLRNEFRYFQRMTTTSSVEGKQNLVI MGKKTWFSIPEKNRPLKGRINLVLSRELKEPPQGA HFLSRSLDDALKLTEQPELANKVDMVWIVGGSSVY KEAMNHPGHLKLFVTRIMQDFESDTFFPEIDLEKYK LLPEYPGVLSDVQEEKGIKYKFEVYEKDD* | 1289 | 4359 |
| OT-hDHFR-024 | Luc2p-Linker (SG)-DHFR (Amino acid 2-187 of WT) (M140I); stop | MEDAKNIKKGPAPFYPLEDGTAGEQLHKAMKRYA LVPGTIAFTDAHIEVDITYAEYFEMSVRLAEAMKR YGLNTNHRIVVCSENSLQFFMPVLGALFIGVAVAP ANDIYNERELLNSMGISQPTVVFVSKKGLQKILNVQ KKLPIIQKIIIMDSKTDYQGFQSMYTFVTSHLPPGFN EYDFVPESFDRDKTIALIMNSSGSTGLPKGVALPHR TACVRFSHARDPIFGNQIIPDTAILSVVPFHHGFGMF TTLGYLICGFRVVLMYRFEEELFLRSLQDYKIQSAL LVPTLFSFFAKSTLIDKYDLSNLHEIASGGAPLSKEV GEAVAKRFHLPGIRQGYGLTETTSAILITPEGDDKP GAVGKVVPFFEAKVVDLDTGKTLGVNQRGELCVR GPMIMSGYVNNPEATNALIDKDGWLHSGDIAYWD EDEHFFIVDRLKSLIKYKGYQVAPAELESILLQHPNI FDAGVAGLPDDDAGELPAAVVVLEHGKTMTEKEI VDYVASQVTTAKKLRGGVVFVDEVPKGLTGKLDA RKIREILIKAKKGGKIAVSGVGSLNCIVAVSQNMGI GKNGDLPWPPLRNEFRYFQRMTTTSSVEGKQNLVI MGKKTWFSIPEKNRPLKGRINLVLSRELKEPPQGA HFLSRSLDDALKLTEQPELANKVDMVWIVGGSSVY KEAMNHPGHLKLFVTRIIQDFESDTFFPEIDLEKYK LLPEYPGVLSDVQEEKGIKYKFEVYEKND* | 1290 | 4360 |
| OT-hDHFR-025 | Luc2p-Linker (SG)-DHFR (Amino acid 2-187 of WT) (N127Y); stop | MEDAKNIKKGPAPFYPLEDGTAGEQLHKAMKRYA LVPGTIAFTDAHIEVDITYAEYFEMSVRLAEAMKR YGLNTNHRIVVCSENSLQFFMPVLGALFIGVAVAP ANDIYNERELLNSMGISQPTVVFVSKKGLQKILNVQ KKLPIIQKIIIMDSKTDYQGFQSMYTFVTSHLPPGFN EYDFVPESFDRDKTIALIMNSSGSTGLPKGVALPHR TACVRFSHARDPIFGNQIIPDTAILSVVPFHHGFGMF TTLGYLICGFRVVLMYRFEEELFLRSLQDYKIQSAL LVPTLFSFFAKSTLIDKYDLSNLHEIASGGAPLSKEV GEAVAKRFHLPGIRQGYGLTETTSAILITPEGDDKP GAVGKVVPFFEAKVVDLDTGKTLGVNQRGELCVR GPMIMSGYVNNPEATNALIDKDGWLHSGDIAYWD EDEHFFIVDRLKSLIKYKGYQVAPAELESILLQHPNI FDAGVAGLPDDDAGELPAAVVVLEHGKTMTEKEI VDYVASQVTTAKKLRGGVVFVDEVPKGLTGKLDA | 1291 | 4361 |

TABLE 7-continued

N terminal and C terminal hDHFR-GFP fusion constructs

| Construct ID | Description | AA Sequence | Amino Acid SEQ ID NO | Nucleic Acid SEQ ID NO |
|---|---|---|---|---|
| | | RKIREILIKAKKGGKIAVSGVGSLNCIVAVSQNMGI GKNGDLPWPPLRNEFRYFQRMTTTSSVEGKQNLVI MGKKTWFSIPEKNRPLKGRINLVLSRELKEPPQGA HFLSRSLDDALKLTEQPELANKVDMVWIVGGSSVY KEAMYHPGHLKLFVTRIMQDFESDTFFPEIDLEKYK LLPEYPGVLSDVQEEKGIKYKFEVYEKND* | | |
| OT-hDHFR-026 | Luc2p -Linker (SG)-DHFR (Amino acid 2-187 of WT) (Y122I); stop | MEDAKNIKKGPAPFYPLEDGTAGEQLHKAMKRYA LVPGTIAFTDAHIEVDITYAEYFEMSVRLAEAMKR YGLNTNHRIVVCSENSLQFFMPVLGALFIGVAVAP ANDIYNERELLNSMGISQPTVVFVSKKGLQKILNVQ KKLPIIQKIIIMDSKTDYQGFQSMYTFVTSHLPPGFN EYDFVPESFDRDKTIALIMNSSGSTGLPKGVALPHR TACVRFSHARDPIFGNQIIPDTAILSVVPFHHGFGMF TTLGYLICGFRVVLMYRFEEELFLRSLQDYKIQSAL LVPTLFSFFAKSTLIDKYDLSNLHEIASGGAPLSKEV GEAVAKRFHLPGIRQGYGLTETTSAILITPEGDDKP GAVGKVVPFFEAKVVDLDTGKTLGVNQRGELCVR GPMIMSGYVNNPEATNALIDKDGWLHSGDIAYWD EDEHFFIVDRLKSLIKYKGYQVAPAELESILLQHPNI FDAGVAGLPDDDAGELPAAVVVLEHGKTMTEKEI VDYVASQVTTAKKLRGGVVFVDEVPKGLTGKLDA RKIREILIKAKKGGKIAVSGVGSLNCIVAVSQNMGI GKNGDLPWPPLRNEFRYFQRMTTTSSVEGKQNLVI MGKKTWFSIPEKNRPLKGRINLVLSRELKEPPQGA HFLSRSLDDALKLTEQPELANKVDMVWIVGGSSVI KEAMNHPGHLKLFVTRIMQDFESDTFFPEIDLEKYK LLPEYPGVLSDVQEEKGIKYKFEVYEKND* | 1292 | 4362 |

DHFR derived DDs described herein and linked to reporter gene e.g. GFP may also be cloned e.g. the protein sequence of SEQ ID NO. 4363, encoded by the nucleotide sequence of SEQ ID NO. 4364 may be cloned into a pLVX-IRES-mcherry vector to generate OT-hDHFR-038, or into a pLVX-P2A-mcherry vector to generate OT-hDHFR-039.

In one embodiment, the DHFR derived DD may be truncated and the smallest DHFR based DD may be identified. In some embodiments, DHFR DDs described herein may also be fragments of the above destabilizing domains, including fragments containing variant amino acid sequences. Preferred fragments are unstable in the absence of the stimulus and stabilized upon addition of the stimulus. Preferred fragments retain the ability to interact with the stimulus with similar efficiency as the DDs described herein.

In some embodiments, the hDHFR-derived SRE may be a hDHFR mutant comprising, but not limited to, one, two, three or more mutations selected from M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N Stimulus Biocircuits of the invention are triggered by one or more stimuli. Stimuli may be selected from a ligand, an externally added or endogenous metabolite, the presence or absence of a defined ligand, pH, temperature, light, ionic strength, radioactivity, cellular location, subject site, microenvironment, the presence or the concentration of one or more metal ions.

In some embodiments, the stimulus is a ligand. Ligands may be nucleic acid-based, protein-based, lipid based, organic, inorganic or any combination of the foregoing. In some embodiments, the ligand is selected from the group consisting of a protein, peptide, nucleic acid, lipid, lipid derivative, sterol, steroid, metabolite derivative and a small molecule. In some embodiments, the stimulus is a small molecule. In some embodiments, the small molecules are cell permeable. Ligands useful in the present invention include without limitation, any of those taught in Table 2 of commonly owned U.S. Ser. No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety. In some embodiments, the small molecules are FDA-approved, safe and orally administered.

In some embodiments, the ligand binds to dihydrofolate reductase. In some embodiments, the ligand binds to and inhibits dihydrofolate reductase function and is herein referred to as a dihydrofolate inhibitor.

In some embodiments, the ligand may be a selective inhibitor of human DHFR. Ligands of the invention may also be selective inhibitors of dihydrofolate reductases of bacteria and parasitic organisms such as *Pneumocystis* spp., *Toxoplasma* spp., *Trypanosoma* spp., *Mycobacterium* spp., and *Streptococcus* spp. Ligands specific to other DHFR may be modified to improve binding to human dihydrofolate reductase.

Examples of dihydrofolate inhibitors include, but are not limited to, Trimethoprim (TMP), Methotrexate (MTX), Pralatrexate, Piritrexim Pyrimethamine, Talotrexin, Chloroguanide, Pentamidine, Trimetrexate, aminopterin, C1 898 trihydrochloride, Pemetrexed Disodium, Raltitrexed, Sulfaguanidine, Folotyn, Iclaprim and Diaveridine. Other examples of DHFR inhibitors include BAL0030543, BAL0030544 and BAL0030545, developed by Basillea Pharmaceuticals; as well as WR 99210, and P218. Any of the inhibitors described by Zhang Q et al. (2015) Int J Antimicrob Agents. 2015 August; 46(2): 174-182 (the contents of which are incorporated herein by reference in their entirety). Some inhibitors contain bulky benzyl groups that dramatically diminish binding to human DHFR. In some embodiments, the inhibitors may be designed without bulky benzyl groups to improve TMP binding.

In some embodiments, ligands of the present invention may be polyglutamate or non polyglutamylatable. Like naturally occurring folates, polyglutamatable folates also contain a glutamic acid residue and therefore undergo intracellular polyglutamylation. In contrast, non-polyglutamatable antifolates are devoid of a glutamate residue and thus are not available for polyglutamylation. In some embodiments, polyglutamylatable ligands may be preferred to increase intracellular retention as they can no longer be exported out of the cell. In other embodiments, non polyglutamylatable ligands may be preferred to decrease intracellular retention.

In some embodiments, ligands of the present invention may include dihydrofolic acid or any of its derivatives that may bind to human DHFR. In some embodiments, the ligands of the present invention, may be 2,4, diaminohetrocyclic compounds. In some embodiments, the 4-oxo group in dihydrofolate may be modified to generate DHFR inhibitors. In one example, the 4-oxo group may be replaced by 4-amino group. Various diamino heterocycles, including pteridines, quinazolines, pyridopyrimidines, pyrimidines, and triazines, may also be used as scaffolds to develop DHFR inhibitors and may be used in the present invention. The crystal structure of DHFR in complex with known DHFR inhibitors may be utilized in the rational design of improved DHFR ligands. The ligands used herein include a 2,4-diaminopyrimidine ring with a propargyl group linked to an optionally substituted aryl or heteroaryl ring (as described in U.S. Pat. No. 8,426,432; the contents of which are incorporated herein by reference in their entirety).

In one embodiment, the ligands of the present invention may be FDA approved ligands capable of binding to the specific DDs or target regions within the DDs. In other embodiments, FDA approved ligands may be used to screen potential binders in the human protein. DDs may be designed based on the positive hits from the screen using the portion of the protein that binds to the ligand. In one embodiment, proteins that bind to FDA approved ligands as off target interactions may be used to design DDs of the present invention.

In some embodiments, ligands include TMP-derived ligands containing portions of the ligand known to mediate binding to DHFR. Ligands may also be modified to reduce off-target binding to other folate metabolism enzymes and increase specific binding to DHFR.

DHFR inhibitors cover a broad pharmacokinetic space with respect to the approved dose and their duration of action and are described in Table 8. In Table 8, PO stands for per os (i.e. by mouth); QD represents quaque die (i.e. every day); IV represents intravenous; TID represents ter un die (i.e. three times a day); and Cmax represents the peak serum concentration that a drug achieves after its administration.

TABLE 8

Pharmacokinetics of DHFR inhibitors

| Drug | Approved Dose | Cmax | Duration of action |
|---|---|---|---|
| Trimethoprim | PO: Up to 20 mg/kg/day<br>IV: 20 mg/kg/6 hr | PO: 1 µM<br>IV: 25 µM | 2-72 hours |
| Methotrexate | PO: 30 mg QD<br>IV infusion: up to 5 g/m$^2$/4 hr | 1.5 µM (12 g/m$^2$ infusion) | >12 hours |

In some embodiments, the ligand selection is determined by the magnitude and duration of expression of the effector modules of the invention using the PK parameters described in Table 8. In some embodiments, high levels of expression of the payload for a short duration of time may be desired. In some embodiments, high levels of expression of the payload may be desired for a long duration. In some embodiments, low levels of expression of the payload may be desired for a long duration of time. In some embodiments, low levels of expression for a short duration of time may be desired. In such instances, TMP may be used as the ligand.

Ligands may also be selected from the analysis of the dependence of a known DHFR ligand on its molecular/chemical structure, through Structure Activity Relationships (SAR) study. Any of the methods related to SAR, known in art may be utilized to identify stabilizing ligands of the invention. SAR may be utilized to improve properties of the ligand such as specificity, potency, pharmacokinetics, bioavailability, and safety. SAR analysis of known DHFR inhibitors may also be combined with computational strategies and the high resolution X-ray structures of DHFR complexed with ligands may be used to develop compounds that can fit these criteria.

Methotrexate is converted to its polyglutamate form, which is required for the intracellular retention, and represents the most preferred substrate for most folate-dependent enzymes. Analysis of the structure of MTX with human and bacterial DHFR has revealed that the active site of hDHFR is larger than ecDHFR which provides a specific interaction with hDHFR. Human DHFR has a much larger active site for TMP as compared to ecDHFR; thus, hDHFR binds to TMP in a different conformation with fewer hydrogen bonds and is thus a poorer fit for the small inhibitor. In some embodiments, the ligands of the invention are designed to be lipophilic to improve cell permeability.

Payloads

According to the present invention, payloads can be any natural protein in an organism genome, a fusion polypeptide, an antibody, or variants, mutants and derivatives thereof.

In some embodiments, payloads of the present invention may be immunotherapeutic agents that induce immune responses in an organism. The immunotherapeutic agent may be, but is not limited to, an antibody and fragments and variants thereof, a chimeric antigen receptor (CAR), a chimeric switch receptor, a cytokine, chemokine, a cytokine receptor, a chemokine receptor, a cytokine-cytokine receptor fusion polypeptide, or any agent that induces an immune response. In one embodiment, the immunotherapeutic agent induces an anti-cancer immune response in a cell, or in a subject.

In some embodiments, payloads of the present invention may be immunotherapeutic agents that induce immune responses in an organism. The immunotherapeutic agent may be a cytokine, a cytokine receptor, a cytokine-cytokine receptor fusion polypeptide or any agent that induces an immune response. In one embodiment, the immunotherapeutic agent induces an anti-cancer immune response in a cell, or in a subject.

1. Protein of Interest

In some embodiments, payloads of the invention may be a natural protein in an organism genome, or variants, mutants, derivatives thereof. The natural protein may be from, for example, a mammalian organism, a bacterium, and a virus.

In one example, the payload may be a protein of interest, or a polypeptide from human genome.

In some embodiments, the payload of the present invention may be cardiac lineage specification factors such as eomesodermin (EOMES), a T-box transcription factor; WNT signaling pathway components such as WNT3 and WNT 3A. EOMES is crucially required for the development of the heart. Cardiomyocyte programming by EOMES involves autocrine activation of the canonical WNT signaling pathway and vice versa. Under conditions that are conducive to promoting cardiac lineage, WNT signaling activates EOMES and EOMES in turn promotes WNT signaling creating a self-sustaining loop that promotes the cardiac lineage. An activation loop that is too weak or too strong promotes non-cardiac fates such as endodermal and other mesodermal fates respectively. The DDs of the present invention may be used to tune EOMES and WNT payload levels to generate an activation loop that initiate and/or sustain cardiac specification during gastrulation.

2. Antibodies, Antibody Fragments and Variants

In some embodiments, antibodies, fragments and variants thereof are payloads of the present invention.

Antibodies useful in this method include without limitation, any of those taught in copending commonly owned U.S. Provisional Patent Application No. 62/320,864 filed on Apr. 11, 2016 or in U.S. Provisional Application No. 62/466, 596 filed Mar. 3, 2017 and the International Publication WO2017/180587, the contents of each of which are incorporated herein by reference in their entirety.

In some embodiments, antibodies of the present invention, include without limitation, any of those taught in Table 5 of copending commonly owned U.S. Provisional Patent Application No. 62/320,864 filed on Apr. 11, 2016, or in U.S. Provisional Application No. 62/466,596 filed Mar. 3, 2017 and the International Publication WO2017/180587, the contents of each of which are incorporated herein by reference in their entirety.

The antibody may be an intact antibody, an antibody light chain, antibody heavy chain, an antibody fragment, an antibody variant, or an antibody derivative.

For the purposes herein, an "antibody" may comprise a heavy and light variable domain as well as an Fc region.

As used herein, the term "native antibody" refers to a usually heterotetrameric glycoprotein of about 150,000 daltons, composed of two identical light (L) chains and two identical heavy (H) chains. Genes encoding antibody heavy and light chains are known and segments making up each have been well characterized and described (Matsuda et al., The Journal of Experimental Medicine. 1998, 188(11): 2151-62 and Li et al., Blood, 2004, 103(12): 4602-4609; the content of each of which are herein incorporated by reference in their entirety). Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains found on both the antibody heavy and light chains that differ extensively in sequence among antibodies and are used in the binding and specificity of each particular antibody for its particular antigen. Variable domains comprise hypervariable regions. As used herein, the term "hypervariable region" refers to a region within a variable domain comprising amino acid residues responsible for antigen binding. The amino acids present within the hypervariable regions determine the structure of the complementarity determining regions (CDRs) that become part of the antigen-binding site of the antibody. As used herein, the term "CDR" refers to a region of an antibody comprising a structure that is complimentary to its target antigen or epitope. Other portions of the variable domain, not interacting with the antigen, are referred to as framework (FW) regions. The antigen-binding site (also known as the antigen combining site or paratope) comprises the amino acid residues necessary to interact with a particular antigen. The exact residues making up the antigen-binding site are typically elucidated by co-crystallography with bound antigen, however computational assessments can also be used based on comparisons with other antibodies (Strohl, W. R. Therapeutic Antibody Engineering. Woodhead Publishing, Philadelphia Pa. 2012. Ch. 3, p 47-54, the contents of which are herein incorporated by reference in their entirety). Determining residues making up CDRs may include the use of numbering schemes including, but not limited to, those taught by Kabat (Wu et al., JEM, 1970, 132(2):211-250 and Johnson et al., Nucleic Acids Res. 2000, 28(1): 214-218, the contents of each of which are herein incorporated by reference in their entirety), Chothia (Chothia and Lesk, J. Mol. Biol. 1987, 196, 901, Chothia et al., Nature, 1989, 342, 877, and Al-Lazikani et al., J. Mol. Biol. 1997, 273(4): 927-948, the contents of each of which are herein incorporated by reference in their entirety), Lefranc (Lefranc et al., Immunome Res. 2005, 1:3) and Honegger (Honegger and Pluckthun, J. Mol. Biol. 2001, 309(3): 657-70, the contents of which are herein incorporated by reference in their entirety).

VH and VL domains have three CDRs each. VL CDRs are referred to herein as CDR-L1, CDR-L2 and CDR-L3, in order of occurrence when moving from N- to C-terminus along the variable domain polypeptide. VH CDRs are referred to herein as CDR-H1, CDR-H2 and CDR-H3, in order of occurrence when moving from N- to C-terminus along the variable domain polypeptide. Each of CDRs have favored canonical structures with the exception of the CDR-H3, which comprises amino acid sequences that may be highly variable in sequence and length between antibodies resulting in a variety of three-dimensional structures in antigen-binding domains (Nikoloudis, et al., Peer J. 2014, 2: e456). In some cases, CDR-H3s may be analyzed among a panel of related antibodies to assess antibody diversity. Various methods of determining CDR sequences are known in the art and may be applied to known antibody sequences (Strohl, W. R. Therapeutic Antibody Engineering. Woodhead Publishing, Philadelphia Pa. 2012. Ch. 3, p 47-54, the contents of which are herein incorporated by reference in their entirety).

As used herein, the term "light chain" refers to a component of an antibody from any vertebrate species assigned to one of two clearly distinct types, called kappa and lambda based on amino acid sequences of constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), e.g., IgG1, IgG2, IgG3, IgG4, IgA, and IgA2.

In some embodiments, the payload maybe a monoclonal antibody. As used herein, the term "monoclonal antibody" refers to an antibody obtained from a population of substantially homogeneous cells (or clones), i.e., the individual antibodies comprising the population are identical and/or bind the same epitope, except for possible variants that may arise during production of the monoclonal antibodies, such variants generally being present in minor amounts. In contrast to polyclonal antibody preparations that typically include different antibodies directed against different determinants (epitopes), each monoclonal antibody is directed against a single determinant on the antigen.

The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

In one embodiment, the payload of the present invention may be a humanized antibody. As used herein, the term "humanized antibody" refers to a chimeric antibody comprising a minimal portion from one or more non-human (e.g., murine) antibody source(s) with the remainder derived from one or more human immunoglobulin sources. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and/or capacity. In one embodiment, the antibody may be a humanized full-length antibody. As a non-limiting example, the antibody may have been humanized using the methods taught in US Patent Publication NO. US20130303399, the contents of which are herein incorporated by reference in its entirety.

In one embodiment, the antibody may comprise a modified Fc region. As a non-limiting example, the modified Fc region may be made by the methods or may be any of the regions described in US Patent Publication NO. US20150065690, the contents of which are herein incorporated by reference in its entirety.

As used herein, the term "antibody variant" refers to a modified antibody (in relation to a native or starting antibody) or a biomolecule resembling a native or starting antibody in structure and/or function (e.g., an antibody mimetic). Antibody variants may be altered in their amino acid sequence, composition or structure as compared to a native antibody. Antibody variants may include, but are not limited to, antibodies with altered isotypes (e.g., IgA, IgD, IgE, IgG1, IgG2, IgG3, IgG4, or IgM), humanized variants, optimized variants, multispecific antibody variants (e.g., bispecific variants), and antibody fragments.

Antibody Fragments and Variants

In some embodiments, antibody fragments and variants may comprise antigen binding regions from intact antibodies. Examples of antibody fragments and variants may include, but are not limited to Fab, Fab', F(ab')2, and Fv fragments; diabodies; linear antibodies; single-chain antibody molecules such as single chain variable fragment (scFv); and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')2 fragment that has two antigen-binding sites and is still capable of cross-linking with the antigen. Pharmaceutical compositions, biocircuits, biocircuit components, effector modules including their SREs or payloads of the present invention may comprise one or more of these fragments.

In some embodiments, antibody fragments and variants may comprise antigen binding regions from intact antibodies. Examples of antibody fragments and variants may include, but are not limited to Fab, Fab', F(ab')2, and Fv fragments; diabodies; linear antibodies; single-chain antibody molecules such as single chain variable fragment (scFv); dimeric single-chain variable fragment (di-scFv), single domain antibody (sdAb) and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')2 fragment that has two antigen-binding sites and is still capable of cross-linking antigen. Pharmaceutical compositions, biocircuits, biocircuit components, effector modules including their SREs or payloads of the present invention may comprise one or more of these fragments.

As used herein, the term "Fv" refers to an antibody fragment comprising the minimum fragment on an antibody needed to form a complete antigen-binding site. These regions consist of a dimer of one heavy chain and one light chain variable domain in tight, non-covalent association. Fv fragments can be generated by proteolytic cleavage, but are largely unstable. Recombinant methods are known in the art for generating stable Fv fragments, typically through insertion of a flexible linker between the light chain variable domain and the heavy chain variable domain (to form a single chain Fv (scFv) or through the introduction of a disulfide bridge between heavy and light chain variable domains (Strohl, W. R. Therapeutic Antibody Engineering.

Woodhead Publishing, Philadelphia Pa. 2012. Ch. 3, p 46-47, the contents of which are herein incorporated by reference in their entirety).

As used herein, the term "single chain Fv" or "scFv" refers to a fusion protein of VH and VL antibody domains, wherein these domains are linked together into a single polypeptide chain by a flexible peptide linker. In some embodiments, the Fv polypeptide linker enables the scFv to form the desired structure for antigen binding. In some embodiments, scFvs are utilized in conjunction with phage display, yeast display or other display methods where they may be expressed in association with a surface member (e.g. phage coat protein) and used in the identification of high affinity peptides for a given antigen.

Using molecular genetics, two scFvs can be engineered in tandem into a single polypeptide, separated by a linker domain, called a "tandem scFv" (tascFv). Construction of a tascFv with genes for two different scFvs yields a "bispecific single-chain variable fragments" (bis-scFvs). Only two tascFvs have been developed clinically by commercial firms; both are bispecific agents in active early phase development by Micromet for oncologic indications, and are described as "Bispecific T-cell Engagers (BiTE)." Blinatumomab is an anti-CD19/anti-CD3 bispecific tascFv that potentiates T-cell responses to B-cell non-Hodgkin lymphoma in Phase 2. MT110 is an anti-EP-CAM/anti-CD3 bispecific tascFv that potentiates T-cell responses to solid tumors in Phase 1. Bispecific, tetravalent "TandAbs" are also being researched by Affimed (Nelson, A. L., MAbs., 2010, January-February; 2(1):77-83). maxibodies (bivalent scFv fused to the amino terminus of the Fc (CH2-CH3 domains) of IgG may also be included.

As used herein, the term "bispecific antibody" refers to an antibody capable of binding two different antigens. Such antibodies typically comprise regions from at least two different antibodies. Bispecific antibodies may include any of those described in Riethmuller, G. Cancer Immunity. 2012, 12:12-18, Marvin et al., 2005. Acta Pharmacologica Sinica. 2005, 26(6): 649-658 and Schaefer et al., PNAS. 2011, 108(27):11187-11192, the contents of each of which are herein incorporated by reference in their entirety. In some aspects, bispecific antibodies may be trifunctional antibodies (3funct) and BiTE (bi-specific T cell engager).

As used herein, the term "diabody" refers to a small antibody fragment with two antigen-binding sites. Diabodies are functional bispecific single-chain antibodies (bscAb). Diabodies comprise a heavy chain variable domain VH connected to a light chain variable domain VL in the same polypeptide chain. By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (Hollinger, P. et al., "Diabodies": Small bivalent and bispecific antibody fragments. PNAS, 1993. 90: 6444-6448); the contents of each of which are incorporated herein by reference in their entirety.

The term "intrabody" refers to a form of antibody that is not secreted from a cell in which it is produced, but instead targets one or more intracellular proteins. Intrabodies may be used to affect a multitude of cellular processes including, but not limited to intracellular trafficking, transcription, translation, metabolic processes, proliferative signaling and cell division. In some embodiments, methods of the present invention may include intrabody-based therapies. In some such embodiments, variable domain sequences and/or CDR sequences disclosed herein may be incorporated into one or more constructs for intrabody-based therapy.

In some embodiments, antibody variants may be antibody mimetics. As used herein, the term "antibody mimetic" refers to any molecule which mimics the function or effect of an antibody and which binds specifically and with high affinity to their molecular targets. In some embodiments, antibody mimetics may be monobodies, designed to incorporate the fibronectin type III domain (Fn3) as a protein scaffold (U.S. Pat. Nos. 6,673,901; 6,348,584). In some embodiments, antibody mimetics may be those known in the art including, but are not limited to affibody molecules, affilins, affitins, anticalins, avimers, Centyrins, DARPINS™, Fynomers and Kunitz and domain peptides. In other embodiments, antibody mimetics may include one or more non-peptide regions.

In some embodiments, antibody variants may be multispecific antibodies that bind more than one epitope. As used herein, the terms "multibody" or "multispecific antibody" refer to an antibody wherein two or more variable regions bind to different epitopes. The epitopes may be on the same or different targets. In one embodiment, the multispecific antibody may be generated and optimized by the methods described in International Patent Publication NO. WO2011109726 and US Patent Publication NO. US20150252119, the contents of which each of which are herein incorporated by reference in their entirety. These antibodies are able to bind to multiple antigens with high specificity and high affinity.

In certain embodiments, a multi-specific antibody is a "bispecific antibody" which recognizes two different epitopes on the same or different antigens. In one aspect, bispecific antibodies are capable of binding two different antigens. Such antibodies typically comprise antigen-binding regions from at least two different antibodies. For example, a bispecific monoclonal antibody (BsMAb, BsAb) is an artificial protein composed of fragments of two different monoclonal antibodies, thus allowing the BsAb to bind to two different types of antigen. Bispecific antibody frameworks may include any of those described in Riethmuller, G., 2012. Cancer Immunity, 2012, 12:12-18; Marvin et al., Acta Pharmacologica Sinica. 2005, 26(6):649-658; and Schaefer et al., PNAS. 2011, 108(27): 11187-11192, the contents of each of which are herein incorporated by reference in their entirety. New generations of BsMAb, called "trifunctional bispecific" antibodies, have been developed. These consist of two heavy and two light chains, one each from two different antibodies, where the two Fab regions (the arms) are directed against two antigens, and the Fc region (the foot) comprises the two heavy chains and forms the third binding site.

In certain embodiments, antibody variants may be antibodies comprising a single antigen-binding domain. These molecules are extremely small, with molecular weights approximately one-tenth of those observed for full-sized mAbs. Further antibodies may include "nanobodies" derived from the antigen-binding variable heavy chain regions (VHHs) of heavy chain antibodies found in camels and llamas, which lack light chains (Nelson, A. L., MAbs.2010. January-February; 2(1):77-83).

In some embodiments, the antibody may be "miniaturized". Among the best examples of mAb miniaturization are the small modular immunopharmaceuticals (SMIPs) from Trubion Pharmaceuticals. These molecules, which can be monovalent or bivalent, are recombinant single-chain molecules containing one VL, one VH antigen-binding domain, and one or two constant "effector" domains, all connected by linker domains. Presumably, such a molecule might offer the advantages of increased tissue or tumor penetration claimed by fragments while retaining the immune effector functions conferred by constant domains. At least three "miniaturized" SMIPs have entered clinical development. TRU-015, an anti-CD20 SMIP developed in collaboration with Wyeth, is the most advanced project, having progressed to Phase 2 for rheumatoid arthritis (RA). Earlier attempts in systemic lupus erythrematosus (SLE) and B cell lymphomas were ultimately discontinued. Trubion and Facet Biotechnology are collaborating in the development of TRU-016, an anti-CD37 SMIP, for the treatment of CLL and other lymphoid neoplasias, a project that has reached Phase 2. Wyeth has licensed the anti-CD20 SMIP SBI-087 for the treatment of autoimmune diseases, including RA, SLE and possibly multiple sclerosis, although these projects remain in the earliest stages of clinical testing. (Nelson, A. L., MAbs, 2010. January-February; 2(1):77-83).

One example of miniaturized antibodies is called "unibody" in which the hinge region has been removed from IgG4 molecules. While IgG4 molecules are unstable and can exchange light-heavy chain heterodimers with one another, deletion of the hinge region prevents heavy chain-heavy chain pairing entirely, leaving highly specific monovalent light/heavy heterodimers, while retaining the Fc region to ensure stability and half-life in vivo. This configuration may minimize the risk of immune activation or oncogenic growth, as IgG4 interacts poorly with FcRs and monovalent unibodies fail to promote intracellular signaling complex formation (see, e.g., Nelson, A. L., MAbs, 2010. January-February; 2(1):77-83).

In some embodiments, antibody variants may include single-domain antibodies (sdAbs, or nanobodies) which are antibody fragment consisting of a single monomeric variable antibody domain. Like a whole antibody, it is able to bind selectively to a specific antigen. In one aspect, a sdAb may be a "Camel Ig or "camelid VHH". As used herein, the term "camel Ig" refers to the smallest known antigen-binding unit of a heavy chain antibody (Koch-No lte, et al, *FASEB J.,* 2007, 21: 3490-3498). A "heavy chain antibody" or a "camelid antibody" refers to an antibody that contains two VH domains and no light chains (Riechmann L. et al, *J. Immunol. Methods,* 1999, 231: 25-38; International patent publication NOs. WO1994/04678 and WO1994/025591; and U.S. Pat. No. 6,005,079). In another aspect, an sdAb may be a "immunoglobulin new antigen receptor" (IgNAR). As used herein, the term "immunoglobulin new antigen receptor" refers to class of antibodies from the shark immune repertoire that consist of homodimers of one variable new antigen receptor (VNAR) domain and five constant new antigen receptor (CNAR) domains. IgNARs represent some of the smallest known immunoglobulin-based protein scaffolds and are highly stable and possess efficient binding characteristics. The inherent stability can be attributed to both (i) the underlying Ig scaffold, which presents a considerable number of charged and hydrophilic surface exposed residues compared to the conventional antibody VH and VL domains found in murine antibodies; and (ii) stabilizing structural features in the complementary determining region (CDR) loops including inter-loop disulphide bridges, and patterns of intra-loop hydrogen bonds.

In some embodiments, antibody variants may include intrabodies. Intrabodies are a form of antibody that is not secreted from a cell in which it is produced, but instead targets one or more intracellular proteins. Intrabodies are expressed and function intracellularly, and may be used to affect a multitude of cellular processes including, but not limited to intracellular trafficking, transcription, translation, metabolic processes, proliferative signaling and cell division. In some embodiments, methods described herein include intrabody-based therapies. In some such embodiments, variable domain sequences and/or CDR sequences disclosed herein are incorporated into one or more constructs for intrabody-based therapy. For example, intrabodies may target one or more glycated intracellular proteins or may modulate the interaction between one or more glycated intracellular proteins and an alternative protein.

The intracellular expression of intrabodies in different compartments of mammalian cells allows blocking or modulation of the function of endogenous molecules (Biocca, et al., *EMBO J.* 1990, 9: 101-108; Colby et al., *Proc. Natl. Acad. Sci. U.S.A.* 2004, 101: 17616-17621). Intrabodies can alter protein folding, protein-protein, protein-DNA, protein-RNA interactions and protein modification. They can induce a phenotypic knockout and work as neutralizing agents by direct binding to the target antigen, by diverting its intracellular trafficking or by inhibiting its association with binding partners. With high specificity and affinity to target antigens, intrabodies have advantages to block certain binding interactions of a particular target molecule, while sparing others.

Sequences from donor antibodies may be used to develop intrabodies. Intrabodies are often recombinantly expressed as single domain fragments such as isolated VH and VL domains or as a single chain variable fragment (scFv) antibody within the cell. For example, intrabodies are often expressed as a single polypeptide to form a single chain antibody comprising the variable domains of the heavy and light chains joined by a flexible linker polypeptide. Intrabodies typically lack disulfide bonds and are capable of modulating the expression or activity of target genes through their specific binding activity. Single chain intrabodies are often expressed from a recombinant nucleic acid molecule and engineered to be retained intracellularly (e.g., retained in the cytoplasm, endoplasmic reticulum, or periplasm). Intrabodies may be produced using methods known in the art, such as those disclosed and reviewed in: (Marasco et al., *PNAS,* 1993, 90: 7889-7893; Chen et al., *Hum. Gene Ther.* 1994, 5:595-601; Chen et al., 1994, *PNAS,* 91: 5932-5936; Maciejewski et al., 1995, *Nature Med.,* 1: 667-673; Marasco, 1995, *Immunotech,* 1: 1-19; Mhashilkar, et al., 1995, *EMBO J.* 14: 1542-51; Chen et al., 1996, *Hum. Gene Therap.,* 7: 1515-1525; Marasco, *Gene Ther.* 4:11-15, 1997; Rondon and Marasco, 1997, Annu. Rev. Microbiol. 51:257-283; Cohen, et al., 1998, Oncogene 17:2445-56; Proba et al., 1998, J. Mol. Biol. 275:245-253; Cohen et al., 1998, Oncogene 17:2445-2456; Hassanzadeh, et al., 1998, FEBS Lett. 437:81-6; Richardson et al., 1998, Gene Ther. 5:635-44; Ohage and Steipe, 1999, J. Mol. Biol. 291:1119-1128; Ohage et al., 1999, J. Mol. Biol. 291:1129-1134; Wirtz and Steipe, 1999, Protein Sci. 8:2245-2250; Zhu et al., 1999, J. Immunol. Methods 231:207-222; Arafat et al., 2000, Cancer Gene Ther. 7:1250-6; der Maur et al., 2002, J. Biol. Chem. 277:45075-85; Mhashilkar et al., 2002, Gene Ther. 9:307-19; and Wheeler et al., 2003, FASEB J. 17: 1733-5; and references cited therein).

In certain embodiments, antibody variants may include biosynthetic antibodies as described in U.S. Pat. No. 5,091,513, the contents of which are herein incorporated by reference in their entirety. Such antibody may include one or more sequences of amino acids constituting a region which behaves as a biosynthetic antibody binding site (BABS). The sites comprise 1) non-covalently associated or disulfide bonded synthetic VH and VL dimers, 2) VH-VL or VL-VH single chains wherein the VH and VL are attached by a polypeptide linker, or 3) individuals VH or VL domains. The binding domains comprise linked CDR and FR regions, which may be derived from separate immunoglobulins. The biosynthetic antibodies may also include other polypeptide sequences which function, e.g., as an enzyme, toxin, binding site, or site of attachment to an immobilization media or radioactive atom. Methods are disclosed for producing the biosynthetic antibodies, for designing BABS having any specificity that can be elicited by in vivo generation of antibody, and for producing analogs thereof.

In some embodiments, antibody variants may include antibodies with antibody acceptor frameworks taught in U.S. Pat. No. 8,399,625. Such antibody acceptor frameworks may be particularly well suited accepting CDRs from an antibody of interest.

In one embodiment, the antibody may be a conditionally active biologic protein. An antibody may be used to generate a conditionally active biologic protein which are reversibly or irreversibly inactivated at the wild type normal physiological conditions as well as to such conditionally active biologic proteins and uses of such conditional active biologic proteins are provided. Such methods and conditionally active proteins are taught in, for example, International Publication Nos. WO2015175375 and WO2016036916 and US Patent Publication No. US20140378660, the contents of each of which are incorporated herein by reference in their entirety.

The preparation of antibodies, whether monoclonal or polyclonal, is known in the art. Techniques for the production of antibodies are well known in the art and described, e.g. in Harlow and Lane "Antibodies, A Laboratory Manual", Cold Spring Harbor Laboratory Press, 1988; Harlow and Lane "Using Antibodies: A Laboratory Manual" Cold Spring Harbor Laboratory Press, 1999 and "Therapeutic Antibody Engineering: Current and Future Advances Driving the Strongest Growth Area in the Pharmaceutical Industry" Woodhead Publishing, 2012.

The antibodies and fragments and variants thereof as described herein can be produced using recombinant polynucleotides. In one embodiment, the polynucleotides have a modular design to encode at least one of the antibodies, fragments or variants thereof. As a non-limiting example, the polynucleotide construct may encode any of the following designs: (1) the heavy chain of an antibody, (2) the light chain of an antibody, (3) the heavy and light chain of the antibody, (4) the heavy chain and light chain separated by a linker, (5) the VH1, CH1, CH2, CH3 domains, a linker and the light chain or (6) the VH1, CH1, CH2, CH3 domains, VL region, and the light chain. Any of these designs may also comprise optional linkers between any domain and region. The polynucleotides of the present invention may be engineered to produce any standard class of immunoglobulins using an antibody described herein or any of its component parts as a starting molecule.

In some embodiments, antibody payloads of the present invention may be therapeutic antibodies. As non-limiting examples, antibodies and fragments and variants thereof may be specific to tumor associated antigens, or tumor specific antigens, or pathogen antigens. In some aspects, antibodies may be blocking antibodies (also referred to as antagonistic antibodies), for example, blocking antibodies against PD-1, PD-L1, PD-L2, CTLA-4 and other inhibitory molecules. In other aspects, antibodies may be agonist antibodies such as agonistic antibodies specific to stimulatory molecules, e.g., 4-1BB (CD137), OX40 (CD134), CD40, GITR and CD27.

Other exemplary therapeutic antibodies may include, but are not limited to, Abagovomab, Abcxmab, Abituzumab, Abrilumab, Actoxumab, Adalimumab, Adecatumumab, Afasevikumab, Afelimomab, Afutuzumab, Alacizumab, Alemtuzumab, Alirocumab, Altumomab, Amatuximab, Anetumab, Anifrolumab, Apolizumab, Arcitumomab, Ascrinvacumab, Aselizumab, Atezolizumab, Atinumab, Atlizumab, Atorolimumab, Avelumab, Bapineuzumab, Basiliximab, Bavituximab, Bectumomab, Begelomab, Belimumab, Benralizumab, Bertilimumab, Besilesomab, Bevacizumab, Bezlotoxumab, Biciromab, Bimagrumab, Bimekizumab, Bivatuzumab, Bleselumab, Blinatumomab, Blinatumomab, Blosozumab, Bococizumab, Brentuximab, Briaknumab, Brodalumab, Brolucizumab, Brontictuzumab, Cabiralizumab, Canakinumab, Cantuzumab, Caplacizumab, Capromab, Carlumab, Carotuximab, Catumaxomab, cBR96-doxorubicin immunoconjugate, Cedelizumab, Cergutuzumab, Certolizumab pegol, Cetuximab, Citatuzumab, Cixutumumab, Clazakizumab, Cleneoliximab, Clivatuzumab, Codrituzumab, Coltuximab, Contatumumab, Concizumab, Crenezumab, Crotedumab, CR6261, Dacetumab, Daclizumab, Dalotuzumab, Dapirolizumab pegol, Daratumumab, Dectrekumab, Demcizumab, Denintuzumab, Denosumab, Derlotuximab biotin, Detumomab, Dinutuximab, Diridavumab, Domagrozumab, Dorlimomab aritox, Drozitumab, Duligotumab, Dupilumab, Durvalumab, Dusigitumab, Ecromeximab, Eculizumab, Edobacomab, Edrecolomab, Efalizumab, Efungumab, Eldelumab, Elgemtumab, Elotuzumab, Elsilimomab, Emactuzumab, Emibetuzumab, Emicizumab, Enavatuzumab, Enfortumab vedotin, Enlimomab pegol, Enoblituzumab, Enokizumab, Enoticumab, Ensituximab, Epitumomab cituxetan, Epratuzumab, Erlizumab, Ertumaxomab, Etaracizumab, Etrolizumab, Evinacumab, Evolocumab, Exbivirumab, Fanolesomab, Faralimomab, Farletuzumab, Fasinumab, FBTA05, Felvizumab, Fezakinumab, Fibatuzumab, Ficlatuzumab, Figitumumab, Firivumab, Flanvotumab, Fletikumab, Fontolizumab, Foralumab, Foravirumab, Fresolimumab, Fulranumab, Futuximab, Galcanezumab, Galiximab, Ganitumab, Gantenerumab, Gavilimomab, Gemtuzumab ozogamicin, Gevokizumab, Girentuximab, Glembatumumab vedotin, Golimumab, Gomiliximab, Guselkumab, Ibalizumab, Ibritumomab tiuxetan, icrucumab, Idarucizumab, Igovomab, IMAB362, Imalumab, Imciromab, Imgatuzumab, Inclacumab, Indatuximab, Indusatumab, Inebilizumab, Infliximab, Intetumumab, Inolimomab, Inotuzumab, Ipilimumab, Iratumumab, Isatuximab, Itolizumab, Ixekizumab, Keliximab, Labetuzumab, Lambrolizumab, Lampalizumab, Lanadelumab, Landogrozumab, Lapritᴜximab, Lebrikizumab, Lemalesomab, Lendalizumab, Lenzilumab, Lerdelimumab, Lexatumumab, Libivirumab, Lifastuzumab, Ligelizumab, Lilotomab, Lintuzumab, Lirilumab, Lodelcizumab, Lokivetmab, Lorvotuzumab, Lucatumumab, Lulizumab pegol, Lumiliximab, Lumretuzumab, Mapatumumab, Margetuximab, Maslimomab, Mavrilimumab, Matuzumab, Mepolizumab, Metelimumab, Milatuzumab, Minretumomab, Mirvetuximab, Mitumomab, Mogamulizumab, Monalizumab, Morolimumab, Motavizumab, Moxetumomab pasudotox, Muromonab-CD3, nacolomab tafenatox, Namilumab, naptumomab, naratuximab, Narnatumab, Natalizumab, Navicixizumab, Navivumab, Nebacumab, Necitumumab, Nemolizumab, Nerelimomab, Nesvacumab, Nimotuzumab, Nivolumab, Nofetumomab, Obiltoxaximab, Obinutuzumab, Ocaratuzumab, Ocrelizumab, Odulimomab, Ofatumumab, Olaratumab, Olaratumab, Olokizumab, Omalizumab, Onartuzumab, Ontuxizumab, Opicinumab, Oportuzumab monatox, Oregovomab, Orticumab, Otelixizumab, Otlertuzumab, Oxelumab, Ozanezumab, Ozoralizumab, Pagibaximab, Palivizumab, Pamrevlumab, Panitumumab, Pankomab, Panobacumab, Parsatuzumab, Pascolizumab, Pasotuxizumab, Pateclizumab, Patritumab, Pembrolizumab, Pemtumomab, Perakizumab, Pertuzumab, Pexelizumab, Pidilizumab, Pinatuzumab, Pintumomab, Placulumab, Plozalizumab, Pogalizumab, Polatuzumab, Ponezumab, Prezalizumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Reslizumab, Rilotumumab, Rinucumab, Risankizumab, Rituximab, Rivabazumab pegol, Robatumumab, Roledumab, Romosozumab, Rontalizumab, Rovalpituzumab, Rovelizumab, Ruplizumab, Sacituzumab, Samalizumab, Sapelizumab, Sarilumab, Satumomab pendetide, Secukinumab, Seribantumab, Setoxaximab, Sevirumab, Sibrotuzumab, SGN-CD19A, SGN-CD33A, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, tabalumab, Tacatuzumab, Tadocizumab, Talizumab, Tamtuvetmab, Tanezumab, Taplitumomab, Tarextumab, Tefibazumab, Telimomab aritox, Tenatumomab, Teneliximab, Teplizumab, Teprotumumab, Tesidolumab, Tetulomab, Tezepelumab, TGN1412, Ticilimumab, Tildrakizumab, Tigatuzumab, Timolumab, Tisotumab vedotin, TNX-650, Tocilizumab, Toralizumab, Tosatoxumab, Tositumomab, Tovetumab, Tralokinumab, Trastuzumab, TRBS07, Tregalizumab, Tremelimumab, Trevogrumab, Tucotuzumab, Tuvirumab, Ublituximab, Ulcocuplumab, Urelumab, Urtoxazumab, Ustekinumab, Vadastuximab talirine, Vandortuzumab vedotin, Vantictumab, Vanucizumab, Vapaliximab, Varlilumab, Vatelizumab, Vedolizumab, Veltuzumab, Vepalimomab, Vesencumab, Visilizumab, Vobarilizumab, Volociximab, Vorsetuzumab, Votumumab, Xentuzumab, Zalutumumab, Zanolimumab, Zatuximab, Ziralimumab and Zolimomab aritox.

Bicistronic and/or Pseudo-Bicistronic Antibody Payloads

According to the present invention, a bicistronic payload is a polynucleotide encoding a two-protein chain antibody on a single polynucleotide strand. A pseudo-bicistronic payload is a polynucleotide encoding a single chain antibody discontinuously on a single polynucleotide strand. For bicistronic payloads, the encoded two strands or two portions/regions and/or domains (as is the case with pseudo-bicistronic) are separated by at least one nucleotide not encoding the strands or domains. More often the separation comprises a cleavage signal or site or a non-coding region of nucleotides. Such cleavage sites include, for example, furin cleavage sites encoded as an "RKR" site, or a modified furin cleavage site in the resultant polypeptide or any of those taught herein.

According to the present invention, a single domain payload comprises one or two polynucleotides encoding a single monomeric variable antibody domain. Typically, single domain antibodies comprise one variable domain (VH) of a heavy-chain antibody.

According to the present invention, a single chain Fv payloads is a polynucleotide encoding at least two coding regions and a linker region. The scFv payload may encode a fusion protein of the variable regions of the heavy (VH) and light chains (VL) of immunoglobulins, connected with a short linker peptide of ten to about 25 amino acids. The linker is usually rich in glycine for flexibility, as well as serine or threonine for solubility, and can either connect the N-terminus of the VH with the C-terminus of the VL, or vice versa. Other linkers include those known in the art and disclosed herein.

According to the present invention, a bispecific payload is a polynucleotide encoding portions or regions of two different antibodies. Bispecific payloads encode polypeptides which may bind two different antigens. Polynucleotides of the present invention may also encode trispecific antibodies having an affinity for three antigens.

For the purposes herein, an "antibody" may comprise a heavy and light variable domain as well as an Fc region. As used herein, the term "native antibody" usually refers to a heterotetrameric glycoprotein of about 150,000 daltons, composed of two identical light (L) chains and two identical heavy (H) chains. Genes encoding antibody heavy and light chains are known and segments making up each have been well characterized and described (Matsuda et al., *The Journal of Experimental Medicine.* 1998, 188(11): 2151-62 and Li et al., *Blood,* 2004, 103(12): 4602-4609; the content of each of which are herein incorporated by reference in their entirety). Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains found on both the antibody heavy and light chains that differ extensively in sequence among antibodies and are used in the binding and specificity of each particular antibody for its particular antigen. Variable domains comprise hypervariable regions. As used herein, the term "hypervariable region" refers to a region within a variable domain comprising amino acid residues responsible for antigen binding. The amino acids present within the hypervariable regions determine the structure of the complementarity determining regions (CDRs) that become part of the antigen-binding site of the antibody. As used herein, the term "CDR" refers to a region of an antibody comprising a structure that is complimentary to its target antigen or epitope. Other portions of the variable domain, not interacting with the antigen, are referred to as framework (FW) regions. The antigen-binding site (also known as the antigen combining site or paratope) comprises the amino acid residues necessary to interact with a particular antigen. The exact residues making up the antigen-binding site are typically elucidated by co-crystallography with bound antigen, however computational assessments based on comparisons with other antibodies can also be used (Strohl, W. R. Therapeutic Antibody Engineering. Woodhead Publishing, Philadelphia Pa. 2012. Ch. 3, p 47-54, the contents of which are herein incorporated by reference in their entirety). Determining residues that make up CDRs may include the use of numbering schemes including, but not limited to, those taught by Kabat (Wu et al., *JEM,* 1970, 132(2):211-250 and Johnson et al., *Nucleic Acids Res.* 2000, 28(1): 214-218, the contents of each of which are herein incorporated by reference in their entirety), Chothia (Chothia and Lesk, *J. Mol. Biol.* 1987, 196, 901, Chothia et al., *Nature,* 1989, 342, 877, and Al-Lazikani et al., *J. Mol. Biol.* 1997, 273(4): 927-948, the contents of each of which are herein incorporated by reference in their entirety), Lefranc (Lefranc et al., *Immunome Res.* 2005, 1:3) and Honegger (Honegger and Pluckthun, *J. Mol. Biol.* 2001, 309(3): 657-70, the contents of which are herein incorporated by reference in their entirety).

VH and VL domains have three CDRs each. VL CDRs are referred to herein as CDR-L1, CDR-L2 and CDR-L3, in order of occurrence when moving from N- to C-terminus along the variable domain polypeptide. VH CDRs are referred to herein as CDR-H1, CDR-H2 and CDR-H3, in order of occurrence when moving from N- to C-terminus along the variable domain polypeptide. Each of CDRs has favored canonical structures with the exception of the CDR-H3, which comprises amino acid sequences that may be highly variable in sequence and length between antibodies resulting in a variety of three-dimensional structures in antigen-binding domains (Nikoloudis, et al., *PeerJ.* 2014, 2: e456). In some cases, CDR-H3s may be analyzed among a panel of related antibodies to assess antibody diversity. Various methods of determining CDR sequences are known in the art and may be applied to known antibody sequences (Strohl, W. R. Therapeutic Antibody Engineering. Woodhead Publishing, Philadelphia Pa. 2012. Ch. 3, p 47-54, the contents of which are herein incorporated by reference in their entirety).

As used herein, the term "Fv" refers to an antibody fragment comprising the minimum fragment on an antibody needed to form a complete antigen-binding site. These regions consist of a dimer of one heavy chain and one light chain variable domain in tight, non-covalent association. Fv fragments can be generated by proteolytic cleavage, but are largely unstable. Recombinant methods are known in the art for generating stable Fv fragments, typically through insertion of a flexible linker between the light chain variable domain and the heavy chain variable domain (to form a single chain Fv (scFv)) or through the introduction of a disulfide bridge between heavy and light chain variable domains (Strohl, W. R. Therapeutic Antibody Engineering. Woodhead Publishing, Philadelphia Pa. 2012. Ch. 3, p 46-47, the contents of which are herein incorporated by reference in their entirety).

As used herein, the term "light chain" refers to a component of an antibody from any vertebrate species assigned to one of two clearly distinct types, called kappa and lambda based on amino acid sequences of constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), e.g., IgG1, IgG2, IgG3, IgG4, IgA, and IgA2.

As used herein, the term "single chain Fv" or "scFv" refers to a fusion protein of VH and VL antibody domains, wherein these domains are linked together into a single polypeptide chain by a flexible peptide linker. In some embodiments, the Fv polypeptide linker enables the scFv to form the desired structure for antigen binding. In some embodiments, scFvs are utilized in conjunction with phage display, yeast display or other display methods where they may be expressed in association with a surface member (e.g. phage coat protein) and used in the identification of high affinity peptides for a given antigen.

Using molecular genetics, two scFvs can be engineered in tandem into a single polypeptide, separated by a linker domain, called a "tandem scFv" (tascFv). Construction of a tascFv with genes for two different scFvs yields a "bispecific single-chain variable fragments" (bis-scFvs). Only two tascFvs have been developed clinically by commercial firms; both are bispecific agents in active early phase development by Micromet for oncologic indications, and are described as "Bispecific T-cell Engagers (BiTE)." Blinatumomab is an anti-CD19/anti-CD3 bispecific tascFv that potentiates T-cell responses to B-cell non-Hodgkin lymphoma in Phase 2. MT110 is an anti-EP-CAM/anti-CD3 bispecific tascFv that potentiates T-cell responses to solid tumors in Phase 1. Bispecific, tetravalent "TandAbs" are also being researched by Affimed (Nelson, A. L., MAbs., 2010, January-February; 2(1):77-83). maxibodies (bivalent scFv fused to the amino terminus of the Fc (CH2-CH3 domains) of IgG may also be included.

As used herein, the term "bispecific antibody" refers to an antibody capable of binding two different antigens. Such antibodies typically comprise regions from at least two different antibodies. Bispecific antibodies may include any of those described in Riethmuller, G. *Cancer Immunity.* 2012, 12:12-18, Marvin et al., 2005. *Acta Pharmacologica Sinica.* 2005, 26(6): 649-658 and Schaefer et al., *PNAS.* 2011, 108(27):11187-11192, the contents of each of which are herein incorporated by reference in their entirety.

As used herein, the term "diabody" refers to a small antibody fragment with two antigen-binding sites. Diabodies are functional bispecific single-chain antibodies (bscAb). Diabodies comprise a heavy chain variable domain VH connected to a light chain variable domain VL in the same polypeptide chain. By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (Hollinger, P. et al., "Diabodies": Small bivalent and bispecific antibody fragments. *PNAS,* 1993. 90: 6444-6448); the contents of each of which are incorporated herein by reference in their entirety.

The term "intrabody" refers to a form of antibody that is not secreted from a cell in which it is produced, but instead targets one or more intracellular proteins. Intrabodies may be used to affect a multitude of cellular processes including, but not limited to intracellular trafficking, transcription, translation, metabolic processes, proliferative signaling and cell division. In some embodiments, methods of the present invention may include intrabody-based therapies. In some such embodiments, variable domain sequences and/or CDR sequences disclosed herein may be incorporated into one or more constructs for intrabody-based therapy.

As used herein, the term "monoclonal antibody" refers to an antibody obtained from a population of substantially homogeneous cells (or clones), i.e., the individual antibodies comprising the population are identical and/or bind the same epitope, except for possible variants that may arise during production of the monoclonal antibodies, such variants generally being present in minor amounts. In contrast to polyclonal antibody preparations that typically include different antibodies directed against different determinants (epitopes), each monoclonal antibody is directed against a single determinant on the antigen.

The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

As used herein, the term "humanized antibody" refers to a chimeric antibody comprising a minimal portion from one or more non-human (e.g., murine) antibody source(s) with the remainder derived from one or more human immunoglobulin sources. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and/or capacity. In one embodiment, the antibody may be a humanized full-length antibody. As a non-limiting example, the antibody may have been humanized using the methods taught in US Patent Publication NO. US20130303399, the contents of which are herein incorporated by reference in its entirety.

As used herein, the term "antibody variant" refers to a modified antibody (in relation to a native or starting antibody) or a biomolecule resembling a native or starting antibody in structure and/or function (e.g., an antibody mimetic). Antibody variants may be altered in their amino acid sequence, composition or structure as compared to a native antibody. Antibody variants may include, but are not limited to, antibodies with altered isotypes (e.g., IgA, IgD, IgE, IgG1, IgG2, IgG3, IgG4, or IgM), humanized variants, optimized variants, multispecific antibody variants (e.g., bispecific variants), and antibody fragments.

In some embodiments, pharmaceutical compositions, biocircuits, biocircuit components, effector modules including their SREs or payloads of the present invention may be antibody mimetics. As used herein, the term "antibody mimetic" refers to any molecule which mimics the function or effect of an antibody and which binds specifically and with high affinity to their molecular targets. In some embodiments, antibody mimetics may be monobodies, designed to incorporate the fibronectin type III domain (Fn3) as a protein scaffold (U.S. Pat. Nos. 6,673,901; 6,348,584). In some embodiments, antibody mimetics may be those known in the art including, but are not limited to affibody molecules, affilins, affitins, anticalins, avimers, Centyrins, DARPINS™, Fynomers and Kunitz and domain peptides. In other embodiments, antibody mimetics may include one or more non-peptide regions.

In one embodiment, the antibody may comprise a modified Fc region. As a non-limiting example, the modified Fc region may be made by the methods or may be any of the regions described in US Patent Publication NO. US20150065690, the contents of which are herein incorporated by reference in its entirety.

In some embodiments, payloads of the invention may encode multispecific antibodies that bind more than one epitope. As used herein, the terms "multibody" or "multispecific antibody" refer to an antibody wherein two or more variable regions bind to different epitopes. The epitopes may be on the same or different targets. In one embodiment, the multispecific antibody may be generated and optimized by the methods described in International Patent Publication NO. WO2011109726 and US Patent Publication NO. US20150252119, the contents of which each of which are herein incorporated by reference in their entirety. These antibodies are able to bind to multiple antigens with high specificity and high affinity.

In certain embodiments, a multi-specific antibody is a "bispecific antibody" which recognizes two different epitopes on the same or different antigens. In one aspect, bispecific antibodies are capable of binding two different antigens. Such antibodies typically comprise antigen-binding regions from at least two different antibodies. For example, a bispecific monoclonal antibody (BsMAb, BsAb) is an artificial protein composed of fragments of two different monoclonal antibodies, thus allowing the BsAb to bind to two different types of antigen. Bispecific antibody frameworks may include any of those described in Riethmuller, G., 2012. Cancer Immunity, 2012, 12:12-18; Marvin et al., Acta Pharmacologica Sinica. 2005, 26(6):649-658; and Schaefer et al., PNAS. 2011, 108(27): 11187-11192, the contents of each of which are herein incorporated by reference in their entirety. New generations of BsMAb, called "trifunctional bispecific" antibodies, have been developed. These consist of two heavy and two light chains, one each from two different antibodies, where the two Fab regions (the arms) are directed against two antigens, and the Fc region (the foot) comprises the two heavy chains and forms the third binding site.

In some embodiments, payloads may encode antibodies comprising a single antigen-binding domain. These molecules are extremely small, with molecular weights approximately one-tenth of those observed for full-sized mAbs. Further antibodies may include "nanobodies" derived from the antigen-binding variable heavy chain regions (VHHs) of heavy chain antibodies found in camels and llamas, which lack light chains (Nelson, A. L., MAbs.2010. January-February; 2(1):77-83).

In some embodiments, the antibody may be "miniaturized". Among the best examples of mAb miniaturization are the small modular immunopharmaceuticals (SMIPs) from Trubion Pharmaceuticals. These molecules, which can be monovalent or bivalent, are recombinant single-chain molecules containing one VL, one VH antigen-binding domain, and one or two constant "effector" domains, all connected by linker domains. Presumably, such a molecule might offer the advantages of increased tissue or tumor penetration claimed by fragments while retaining the immune effector functions conferred by constant domains. At least three "miniaturized" SMIPs have entered clinical development. TRU-015, an anti-CD20 SMIP developed in collaboration with Wyeth, is the most advanced project, having progressed to Phase 2 for rheumatoid arthritis (RA). Earlier attempts in systemic lupus erythrematosus (SLE) and B cell lymphomas were ultimately discontinued. Trubion and Facet Biotechnology are collaborating in the development of TRU-016, an anti-CD37 SMIP, for the treatment of CLL and other lymphoid neoplasias, a project that has reached Phase 2. Wyeth has licensed the anti-CD20 SMIP SBI-087 for the treatment of autoimmune diseases, including RA, SLE and possibly multiple sclerosis, although these projects remain in the earliest stages of clinical testing. (Nelson, A. L., MAbs, 2010. January-February; 2(1):77-83).

On example of miniaturized antibodies is called "unibody" in which the hinge region has been removed from IgG4 molecules. While IgG4 molecules are unstable and can exchange light-heavy chain heterodimers with one another, deletion of the hinge region prevents heavy chain-heavy chain pairing entirely, leaving highly specific monovalent light/heavy heterodimers, while retaining the Fc region to ensure stability and half-life in vivo. This configuration may minimize the risk of immune activation or oncogenic growth, as IgG4 interacts poorly with FcRs and monovalent unibodies fail to promote intracellular signaling complex formation (see, e.g., Nelson, A. L., MAbs, 2010. January-February; 2(1):77-83).

In some embodiments, payloads of the invention may encode single-domain antibodies (sdAbs, or nanobodies) which are antibody fragment consisting of a single monomeric variable antibody domain. Like a whole antibody, it is able to bind selectively to a specific antigen. In one aspect, a sdAb may be a "Camel Ig or "camelid VHH". As used herein, the term "camel Ig" refers to the smallest known antigen-binding unit of a heavy chain antibody (Koch-Nolte, et al, *FASEB J.*, 2007, 21: 3490-3498). A "heavy chain antibody" or a "camelid antibody" refers to an antibody that contains two VH domains and no light chains (Riechmann L. et al, *J. Immunol. Methods*, 1999, 231: 25-38; International patent publication NOs. WO1994/04678 and WO1994/025591; and U.S. Pat. No. 6,005,079). In another aspect, a sdAb may be a "immunoglobulin new antigen receptor" (IgNAR). As used herein, the term "immunoglobulin new antigen receptor" refers to class of antibodies from the shark immune repertoire that consist of homodimers of one variable new antigen receptor (VNAR) domain and five constant new antigen receptor (CNAR) domains. IgNARs represent some of the smallest known immunoglobulin-based protein scaffolds and are highly stable and possess efficient binding characteristics. The inherent stability can be attributed to both (i) the underlying Ig scaffold, which presents a considerable number of charged and hydrophilic surface exposed residues compared to the conventional antibody VH and VL domains found in murine antibodies; and (ii) stabilizing structural features in the complementary determining region (CDR) loops including inter-loop disulphide bridges, and patterns of intra-loop hydrogen bonds.

In some embodiments, payloads of the invention may encode intrabodies. Intrabodies are a form of antibody that is not secreted from a cell in which it is produced, but instead targets one or more intracellular proteins. Intrabodies are expressed and function intracellularly, and may be used to affect a multitude of cellular processes including, but not limited to intracellular trafficking, transcription, translation, metabolic processes, proliferative signaling and cell division. In some embodiments, methods described herein include intrabody-based therapies. In some such embodiments, variable domain sequences and/or CDR sequences disclosed herein are incorporated into one or more constructs for intrabody-based therapy. For example, intrabodies may target one or more glycated intracellular proteins or may modulate the interaction between one or more glycated intracellular proteins and an alternative protein.

The intracellular expression of intrabodies in different compartments of mammalian cells allows blocking or modulation of the function of endogenous molecules (Biocca, et al., *EMBO J.* 1990, 9: 101-108; Colby et al., *Proc. Natl. Acad. Sci. U.S.A.* 2004, 101: 17616-17621). Intrabodies can alter protein folding, protein-protein, protein-DNA, protein-RNA interactions and protein modification. They can induce a phenotypic knockout and work as neutralizing agents by direct binding to the target antigen, by diverting its intracellular trafficking or by inhibiting its association with binding partners. With high specificity and affinity to target antigens, intrabodies have advantages to block certain binding interactions of a particular target molecule, while sparing others.

Sequences from donor antibodies may be used to develop intrabodies. Intrabodies are often recombinantly expressed as single domain fragments such as isolated VH and VL domains or as a single chain variable fragment (scFv) antibody within the cell. For example, intrabodies are often expressed as a single polypeptide to form a single chain antibody comprising the variable domains of the heavy and light chains joined by a flexible linker polypeptide. Intrabodies typically lack disulfide bonds and are capable of modulating the expression or activity of target genes through their specific binding activity. Single chain intrabodies are often expressed from a recombinant nucleic acid molecule and engineered to be retained intracellularly (e.g., retained in the cytoplasm, endoplasmic reticulum, or periplasm). Intrabodies may be produced using methods known in the art, such as those disclosed and reviewed in: (Marasco et al., *PNAS*, 1993, 90: 7889-7893; Chen et al., *Hum. Gene Ther.* 1994, 5:595-601; Chen et al., 1994, *PNAS*, 91: 5932-5936; Maciejewski et al., 1995, *Nature Med.*, 1: 667-673; Marasco, 1995, *Immunotech*, 1: 1-19; Mhashilkar, et al., 1995, *EMBO J.* 14: 1542-51; Chen et al., 1996, *Hum. Gene Therap.*, 7: 1515-1525; Marasco, *Gene Ther.* 4:11-15, 1997; Rondon and Marasco, 1997, Annu. Rev. Microbiol. 51:257-283; Cohen, et al., 1998, Oncogene 17:2445-56; Proba et al., 1998, J. Mol. Biol. 275:245-253; Cohen et al., 1998, Oncogene 17:2445-2456; Hassanzadeh, et al., 1998, FEBS Lett. 437:81-6; Richardson et al., 1998, Gene Ther. 5:635-44; Ohage and Steipe, 1999, J. Mol. Biol. 291:1119-1128; Ohage et al., 1999, J. Mol. Biol. 291:1129-1134; Wirtz and Steipe, 1999, Protein Sci. 8:2245-2250; Zhu et al., 1999, J. Immunol. Methods 231:207-222; Arafat et al., 2000, Cancer Gene Ther. 7:1250-6; der Maur et al., 2002, J. Biol. Chem. 277:45075-85; Mhashilkar et al., 2002, Gene Ther. 9:307-19; and Wheeler et al., 2003, FASEB J. 17: 1733-5; and references cited therein).

In some aspects, payloads of the invention may encode biosynthetic antibodies as described in U.S. Pat. No. 5,091, 513, the contents of which are herein incorporated by reference in their entirety. Such antibody may include one or more sequences of amino acids constituting a region which behaves as a biosynthetic antibody binding site (BABS). The sites comprise 1) non-covalently associated or disulfide bonded synthetic VH and VL dimers, 2) VH-VL or VL-VH single chains wherein the VH and VL are attached by a polypeptide linker, or 3) individuals VH or VL domains. The binding domains comprise linked CDR and FR regions, which may be derived from separate immunoglobulins. The biosynthetic antibodies may also include other polypeptide sequences which function, e.g., as an enzyme, toxin, binding site, or site of attachment to an immobilization media or radioactive atom. Methods are disclosed for producing the biosynthetic antibodies, for designing BABS having any specificity that can be elicited by in vivo generation of antibody, and for producing analogs thereof.

In some embodiments, payloads may encode antibodies with antibody acceptor frameworks taught in U.S. Pat. No. 8,399,625. Such antibody acceptor frameworks may be particularly well suited accepting CDRs from an antibody of interest.

In one embodiment, the antibody may be a conditionally active biologic protein. An antibody may be used to generate a conditionally active biologic protein which are reversibly or irreversibly inactivated at the wild type normal physiological conditions as well as to such conditionally active biologic proteins and uses of such conditional active biologic proteins are provided. Such methods and conditionally active proteins are taught in, for example, International Publication No. WO2015175375 and WO2016036916 and US Patent Publication No. US20140378660, the contents of each of which are incorporated herein by reference in their entirety.

Antibody Preparations

The preparation of antibodies, whether monoclonal or polyclonal, is known in the art. Techniques for the production of antibodies are well known in the art and described, e.g. in Harlow and Lane "Antibodies, A Laboratory Manual", Cold Spring Harbor Laboratory Press, 1988; Harlow and Lane "Using Antibodies: A Laboratory Manual" Cold Spring Harbor Laboratory Press, 1999 and "Therapeutic Antibody Engineering: Current and Future Advances Driving the Strongest Growth Area in the Pharmaceutical Industry" Woodhead Publishing, 2012.

The antibodies and fragments and variants thereof as described herein can be produced using recombinant polynucleotides. In one embodiment, the polynucleotides have a modular design to encode at least one of the antibodies, fragments or variants thereof. As a non-limiting example, the polynucleotide construct may encode any of the following designs: (1) the heavy chain of an antibody, (2) the light chain of an antibody, (3) the heavy and light chain of the antibody, (4) the heavy chain and light chain separated by a linker, (5) the VH1, CH1, CH2, CH3 domains, a linker and the light chain or (6) the VH1, CH1, CH2, CH3 domains, VL region, and the light chain. Any of these designs may also comprise optional linkers between any domain and/or region. The polynucleotides of the present invention may be engineered to produce any standard class of immunoglobulins using an antibody described herein or any of its component parts as a starting molecule.

Recombinant antibody fragments may also be isolated from phage antibody libraries using techniques well known in the art and described in e.g. Clackson et al., 1991, Nature 352: 624-628; Marks et al., 1991, J. Mol. Biol. 222: 581-597. Recombinant antibody fragments may be derived from large phage antibody libraries generated by recombination in bacteria (Sblattero and Bradbury, 2000, Nature Biotechnology 18:75-80; the contents of which are incorporated herein by reference in its entirety).

Antibodies Used for Immunotherapy

In some embodiments, payloads of the present invention may be antibodies, fragments and variants thereof which are specific to tumor specific antigens (TSAs) and tumor associated antigens (TAAs). Antibodies circulate throughout the body until they find and attach to the TSA/TAA. Once attached, they recruit other parts of the immune system, increasing ADCC (antibody dependent cell-mediated cytotoxicity) and ADCP (antibody dependent cell-mediated phagocytosis) to destroy tumor cells. As used herein, the term "tumor specific antigen (TSA)" means an antigenic substance produced in tumor cells, which can trigger an anti-tumor immune response in a host organism. In one embodiment, a TSA may be a tumor neoantigen. The tumor antigen specific antibody mediates complement-dependent cytotoxic response against tumor cells expressing the same antigen.

In some embodiments, the tumor specific antigens (TSAs), tumor associated antigens (TAAs), pathogen associated antigens, or fragments thereof can be expressed as a peptide or as an intact protein or portion thereof. The intact protein or a portion thereof can be native or mutagenized. Antigens associated with cancers or virus-induced cancers as described herein are well-known in the art. Such a TSA or TAA may be previously associated with a cancer or may be identified by any method known in the art.

In one embodiment, the antigen is CD19, a B-cell surface protein expressed throughout B-cell development. CD19 is a well-known B cell surface molecule, which upon B cell receptor activation enhances B-cell antigen receptor induced signaling and expansion of B cell populations. CD19 is broadly expressed in both normal and neoplastic B cells. Malignancies derived from B cells such as chronic lymphocytic leukemia, acute lymphocytic leukemia and many non-Hodgkin lymphomas frequently retain CD19 expression. This near universal expression and specificity for a single cell lineage has made CD19 an attractive target for immunotherapies. Human CD19 has 14 exons wherein exon 1-4 encode the extracellular portion of the CD19, exon 5 encodes the transmembrane portion of CD19 and exons 6-14 encode the cytoplasmic tail.

In one embodiment, payloads of the present invention may be antibodies, fragments and variants thereof which are specific to CD19 antigen.

In one embodiment, the payload of the invention may be a FMC63 antibody, antibody fragment of variant. FMC63 is an IgG2a mouse monoclonal antibody clone specific to the CD19 antigen that reacts with CD19 antigen on cells of the B cell lineage. The epitope of CD19 recognized by the FMC63 antibody is in exon 2 (Sotillo et al (2015) Cancer Discov; 5(12): 1282-95; the contents of which are incorporated by reference in their entirety). In some embodiments, the payload of the invention may be other CD19 monoclonal antibody clones including but not limited to 4G7, SJ25C1, CVID3/429, CVID3/155, HIB19, and J3-119.

In some embodiments, the payloads of the present invention may include variable heavy chain and variable light chain comprising the amino acid sequences selected from those in Table 9.

TABLE 9

Variable Heavy and Light Chain Sequences

| Target | Antibody chain | SEQ ID NO | Source |
|---|---|---|---|
| CD19 | VH | 4365 | SEQ ID NO: 28 in WO2016168773A3 |
| CD19 | VH | 4366 | SEQ ID NO: 29 in WO2016168773A3 |
| CD19 | VH | 4367 | SEQ ID NO: 32 in WO2016168773A3 |
| CD19 | VH | 4368 | SEQ ID NO: 33 in WO2016168773A3 |
| CD19 | VH | 4369 | SEQ ID NO: 34 in WO2016168773A3 |
| CD19 | VH | 4370 | SEQ ID NO: 35 in WO2016168773A3 |
| CD19 | VH | 4371 | SEQ ID NO: 51 in WO2016187349A1 |
| CD19 | VH | 4372 | SEQ ID NO: 20 in US20160039942 |
| CD19 | VH | 4373 | SEQ ID NO. 1 in WO2014184143 |
| CD19 | VH | 4374 | SEQ ID NO. 5 in US20160145337A1 |
| CD19 | VH | 4375 | SEQ ID NO: 15 in US20160319020 |
| CD19 | VH | 4376 | SEQ ID NO: 166 in US20160152723 |
| CD19 | VH | 4377 | SEQ ID NO: 167 in US20160152723 |
| CD19 | VH | 4378 | SEQ ID NO: 168 in US20160152723 |
| CD19 | VH | 4379 | SEQ ID NO: 17 in EP3057991A1 |
| CD19 | VH | 4380 | SEQ ID NO: 172 in US20160152723 |
| CD19 | VH | 4381 | SEQ ID NO: 176 in US20160152723 |
| CD19 | VH | 4382 | SEQ ID NO: 177 in US20160152723 |
| CD19 | VH | 4383 | SEQ ID NO: 181 in US20160152723 |
| CD19 | VH | 4384 | SEQ ID NO: 183 in US20160152723 |
| CD19 | VH | 4385 | SEQ ID NO: 184 in US20160152723 |
| CD19 | VH | 4386 | SEQ ID NO: 185 in US20160152723 |
| CD19 | VH | 4387 | SEQ ID NO: 62 in US20160152723 |
| CD19 | VH | 4388 | SEQ ID NO: 62 in WO2016097231 |
| CD19 | VH | 4389 | SEQ ID NO. 12 in WO2016134284 |
| CD19 | VH | 4390 | SEQ ID NO: 111 in US20160333114A1 |
| CD19 | VH | 4391 | SEQ ID NO: 113 in US20160333114A1 |
| CD19 | VH | 4392 | SEQ ID NO: 33 in EP3057994A1 |
| CD19 | VH | 4393 | SEQ ID NO: 34 in EP3057994A1 |
| CD19 | VH | 4394 | SEQ ID NO: 35 in EP3057994A1 |
| CD19 | VH | 4395 | SEQ ID NO. 53 in WO2016120216 |
| CD19 | VH | 4396 | SEQ ID NO. 55 in WO2016120216 |

TABLE 9-continued

Variable Heavy and Light Chain Sequences

| Target | Antibody chain | SEQ ID NO | Source |
|---|---|---|---|
| CD19 | VK | 4397 | SEQ ID NO: 13 in US20160319020 |
| CD19 | VK | 4398 | SEQ ID NO: 6 in US20160319020 |
| CD19 | VL | 4399 | SEQ ID NO: 27 in WO2016168773A3 |
| CD19 | VL | 4400 | SEQ ID NO: 31 in WO2016168773A3 |
| CD19 | VL | 4401 | SEQ ID NO: 49 in WO2016187349A1 |
| CD19 | VL | 4402 | SEQ ID NO. 11 in WO2016134284 |
| CD19 | VL | 4403 | SEQ ID NO. 194 in US20140134142A1 |
| CD19 | VL | 4404 | SEQ ID NO. 54 in WO2016120216 |
| CD19 | VL | 4405 | SEQ ID NO. 56 in WO2016120216 |
| CD19 | VL | 4406 | SEQ ID NO: 13 in US20160152723 |
| CD19 | VL | 4407 | SEQ ID NO: 14 in US20160152723 |
| CD19 | VL | 4408 | SEQ ID NO: 15 in US20160152723 |
| CD19 | VL | 4409 | SEQ ID NO: 16 in US20160152723 |
| CD19 | VL | 4410 | SEQ ID NO: 17 in US20160152723 |
| CD19 | VL | 4411 | SEQ ID NO: 186 in US20160152723 |
| CD19 | VL | 4412 | SEQ ID NO: 187 in US20160152723 |
| CD19 | VL | 4413 | SEQ ID NO: 188 US20160152723 |
| CD19 | VL | 4414 | SEQ ID NO: 189 in US20160152723 |
| CD19 | VL | 4415 | SEQ ID NO: 192 in US20160152723 |
| CD19 | VL | 4416 | SEQ ID NO: 196 in US20160152723 |
| CD19 | VL | 4417 | SEQ ID NO: 197 in US20160152723 |
| CD19 | VL | 4418 | SEQ ID NO: 198 in US20160152723 |
| CD19 | VL | 4419 | SEQ ID NO: 199 in US20160152723 |
| CD19 | VL | 4420 | SEQ ID NO: 200 in US20160152723 |
| CD19 | VL | 4421 | SEQ ID NO: 201 in US20160152723 |
| CD19 | VL | 4422 | SEQ ID NO: 202 in US20160152723 |
| CD19 | VL | 4423 | SEQ ID NO: 203 in US20160152723 |
| CD19 | VL | 4424 | SEQ ID NO: 204 in US20160152723 |
| CD19 | VL | 4425 | SEQ ID NO: 205 in US20160152723 |
| CD19 | VL | 4426 | SEQ ID NO: 22 in US20160039942 |
| CD19 | VL | 4427 | SEQ ID NO: 63 in WO2016097231 |
| CD19 | VL | 4428 | SEQ ID NO: 64 in US20160152723 |
| CD19 | VL | 4429 | SEQ ID NO: 66 in US20160152723 |
| CD19 | VL | 4430 | SEQ ID NO: 67 in US20160152723 |
| CD19 | VL | 4431 | SEQ ID NO: 68 in US20160152723 |
| CD19 | VL | 4432 | SEQ ID NO: 69 in US20160152723 |
| CD19 | VL | 4433 | SEQ ID NO: 70 in US20160152723 |
| CD19 | VL | 4434 | SEQ ID NO: 71 in US20160152723 |
| CD19 | VL | 4435 | SEQ ID NO: 91 in US20160152723 |
| CD19 | VL | 4436 | SEQ ID NO. 3 in US20160145337A1 |
| CD19 | VL | 4437 | SEQ ID NO: 112 in US20160333114A1 |
| CD19 | VL | 4438 | SEQ ID NO: 114 in US20160333114A1 |

A tumor specific antigen (TSA) may be a tumor neoantigen. A neoantigen is a mutated antigen that is only expressed by tumor cells because of genetic mutations or alterations in transcription which alter protein coding sequences, therefore creating novel, foreign antigens. The genetic changes result from genetic substitution, insertion, deletion or any other genetic changes of a native cognate protein (i.e. a molecule that is expressed in normal cells). In the context of CD19, neoantigens such as a transcript variant of CD19 lacking exon 2 or lacking exon 5-6 or both have been described (see International patent publication No. WO2016061368; the contents of which are incorporated herein by reference in their entirety). Since FMC63 binding epitope is in exon 2, CD19 neoantigen lacking exon 2 is not recognized by FMC63 antibody. Thus, in some embodiments, payloads of the invention may include FMC63-distinct antibodies, or fragments thereof. As used herein "FMC63-distinct" refers, to an antibody or fragment thereof that is immunologically specific and binds to an epitope of the CD19 antigen that is different or unlike the epitope of CD19 antigen that is bound by FMC63. In some instances, antibodies of the invention may include CD19 antibodies, antibody fragments or variants that recognize CD19 neoantigens including the CD19 neoantigen lacking exon2. In one embodiment, the antibody or fragment thereof is immunologically specific to the CD19 encoded by exon 1, 3 and/or 4. In one example, the antibody or fragment thereof is specific to the epitope that bridges the portion of CD19 encoded by exon 1 and the portion of CD19 encoded by exon 3.

In one embodiment, the antigen may be GD2 ganglioside. In one embodiment, payloads of the present invention may be antibodies, fragments and variants thereof which are specific to GD2 antigen. Gangliosides expressed on the tumor cell surface can be targets for cancer immunotherapy. GD2 is a disialoganglioside with a molecular formula of $C_{74}H_{134}N_4O_{32}$. Gangliosides are acidic glycosphingolipids found on the outer surface of most cell membranes. They are ideal targets for immunotherapy because of the high antigen density, lack of modulation, relative homogeneity in many tumors and the possibility of up regulation by cytokines. Many tumors have abnormal glycolipid composition and structure. GD2 has been found in a wide spectrum of human tumors, including those of neuroectodermal or epithelial origin, virtually all melanomas, and approximately 50% of tumor samples from osteosarcoma and soft tissue sarcoma. Antibodies with high affinity for GD2 include, but not limited to 1B7, 2H12, 1G2, 1E9, 1H3, 2F5, 2F7, 31F9, 31F9V2, 32E2, chl4.18, hul4.18, 3F8, 8B6, 4B5, 1A7, A1G4, GD2 mimotopes, hul4.18K322A, 5F11, 3G6, 14g2a, and 14.18. In one embodiment, the GD antibody is the 14g2a antibody (Mujoo K., et al. (1989) Cancer Res. 1; 49(11): 2857-61; the contents of which are incorporated herein by reference in its entirety). Any of the GD2 antibodies described in Long A. H. et al. (2015) Nat Med. 21(6):581-90; the contents of which are incorporated by reference in their entirety).

In one embodiment, the antigen is HER2 antigen. In one embodiment, payloads of the present invention may be antibodies, fragments and variants thereof which are specific to HER2 antigen. HER2 is the oncogene product of human epidermal cell growth factor receptor 2 related oncogenes and is a transmembrane receptor protein having a molecular weight of 185 kDa and having a tyrosine kinase domain. HER2 is a member of the EGFR family consisting of HER1 (EGFR, ERBB1), HER2 (neu, ERBB-2), HER2 (ErbB-3), and Her4 (ErbB-4) and is known to be autophosphorylated at intracellular tyrosine residues by its homodimer formation or heterodimer formation with another EGFR receptor HER1, HER3, HER4 and is activated in this manner. Thereby playing an important role in cell growth, differentiation, and survival in normal cells and tumor cells. In some embodiments, HER2 antibodies useful in the present invention may include 3B5 (from Oncogene Science/BAYER), 2C4 (ATCC HB-12697), 7C2 (ATCC HB-12215), ApoB17F/ocHER2, 8A4 (ATCC PTA-4565), A10A12 (ATCC PTA-4566), 9G6, 7H4, A10E9, A12D6, A6B12, A10E11, B3G4, A5C7, 13A11, 11C11, 13E11, Her2Bi (OKT3×9184), Her2Bi (OKT3×Herc), 7F3 (ATCC HB-12216), huMAb4D5-1, huMAb4D5-2, huMAb4D5-3, huMAb4D5-4, huMAb4D5-6, huMAb4D5-7, 520C9, CB-11 (from Novocastra Laboratories), NCLB12 (from Novocastra Laboratories), humanized 2C4 mutant 560, humanized 2C4 mutant 561, humanized 2C4 mutant 562, humanized 2C4 mutant 568, humanized 2C4 mutant 569, humanized 2C4 mutant 570, humanized 2C4 mutant 571, humanized 2C4 mutant 56869, 3E8, 3H4, Cl 11 (NeoMarkers), HER-81, 452F2, 736G9, 741F8, 758G5, 761B10, anti-p185HER2/FcγRIII (CD16), anti-CD3/anti-p185HER2, Hu4D5-8 and variants, 4D5-H, CB11 (from Ventana Medical Scientific Instruments), 6E9, 2H11, 5B8, 7D3, HER50, HER66, HER70, scFv C6.5, scFv C6ML3-9 (ML3.9 or C6ML3.9), scFv C6MH3-B1 (B1 or C6MH3.B1), scFv C6-B1D2, (B1D2 or C6MH3-B1D2), ALM, L87, N28, N12, MGr6, 9GG.10 (Neomarkers), MGFc-5 (V379M), MGFc-9 (F243I, V379L), MGFc-10 (K288N, A330S, P396L), MGFc-13 (K334E, T359N, T366S), MGFc-27 (G316D, A378V, D399E), MGFc-37 (K248M), MGFc-39 (E293V Q295E, A327T), MGFc-38 (K392T, P396L), MGFc-41 (H268N, P396L), MGFc-23 (K334E, R292L), MGFc-44, MGFc-45, MDX-210, 17.6.4, HER2-PY1248, MAb74, FRP5, TAb250, HER-81, PN2A, mAb 191924 (R&D systems), IDM1, scFv23, Ab-3, Ab-5, 2502A, Rexomun, MAB-1129 (R&D systems), and MM-111. In one embodiment, antibodies with high affinity may be derived from any of the HER2 antibody heavy and light chain variables described in Table 7.

In one embodiment of the present invention, the antigen is CD33. In one embodiment, payloads of the present invention may be antibodies, fragments and variants thereof which are specific to CD33 antigen. Acute myeloid leukemia (AML) is the second most common acute leukemia in the United States. The commonly applied therapy of leukemic disease includes irradiation and/or chemotherapy. However, very often 65-80% of patients receiving treatment relapse because the cells that survived the chemotherapy are enriched in AML leukemia stem cells (AML-LSCs), and constitute a reservoir of cells capable of re-expanding and causing a relapse. AML-LSCs express a characteristic set of cell surface antigens including among other CD33. CD33 (Sialic acid binding Ig-like lectin 3) or SIGLEC3 (UNIPROT ID: P20138) is a transmembrane receptor expressed on cells of myeloid lineage. It is usually considered myeloid specific, but it can also be found on some lymphoid cells. It binds to sialic acid, therefore is a member of the SIGLEC family of lectins. Exemplary antibodies targeting CD33 may include, but are not limited to M195, M2H12, DRB2, My 9-6. In one embodiment, the antibody is derived from My9.6. In some embodiments, antibodies with high affinity may be derived from any of the CD33 antibody heavy and light chain variables described in Table 10.

In one embodiment, the antigen of the present invention is a BCMA (B-cell maturation antigen), also referred to as the CD269. In one embodiment, payloads of the present invention may be antibodies, fragments and variants thereof which are specific to BCMA antigen. BCMA antigen (UNIPROT ID: Q02223) is encoded by the gene, TNFRS17. BCMA is a member of the TNF receptor super family. It binds to B cell activating factor (BAFF) and a proliferation inducing ligand (APRIL). Among non-malignant cells, BCMA has been reported to be expressed mostly by plasma cells and subsets of mature B cells, but not T cells and NK cells. Therefore, BCMA represents a suitable therapeutic candidate in the treatment of multiple myeloma. Exemplary antibodies targeting BCMA include, but are not limited to BCMA 50, BCMA30, C11D5.3 and C13F12.1. In one embodiment, the antibody is derived from C11D5.3. In some embodiments, antibodies with high affinity may be derived from any of the BCMA antibody heavy and light chain variables described in Table 10.

In one embodiment, the antigen of the present invention is a CD276 (also known as B7-H3). In one embodiment, payloads of the present invention may be antibodies, fragment, and variants thereof which are specific to CD276. CD276 is expressed in a variety of human tumors, including pediatric solid tumors and adult carcinomas. Any of the CD276 antibodies taught in International Patent publications WO2017044699 and WO2014160627 (the contents of which are incorporated herein by reference in their entirety), may be useful in the present invention. In some embodiments, antibodies with high affinity may be derived from any of the CD276 antibody heavy and light chain variables described in Table 10.

In one embodiment, the antigen of the present invention is a ALK protein. The developmentally-regulated cell surface receptor tyrosine kinase, ALK is known to be expressed as a tumor associated antigen as a fusion protein resulting from a chromosomal translocation. Cancer associated ALK was first described as a 2;5 translocation associated with nucleophosphomin (NPM) in anaplastic large cell leukemia. The fusion protein is composed of intracellular component of NPM fused to ALK. In some embodiments, the ALK antigen may be the extracellular portion of the protein. Any of the antibodies, fragment and variants specific to ALK may be useful in the present invention. In one embodiment, the ALK antibodies described in the International Patent Publication, WO2015069922 (the contents of which are incorporated by reference herein in its entirety). In some embodiments, antibodies with high affinity may be derived from any of the ALK antibody heavy and light chain variables described in Table 10.

In one embodiment, the antigen of the present invention is a CD22 antigen. In one embodiment, payloads of the present invention may be antibodies, fragment, and variants thereof which are specific to CD22. CD22 is a lineage restricted B cell antigen belonging to the immunoglobulin (Ig) superfamily. CD22 is expressed in 60-70% of B cell lymphomas and leukemias (e.g. B-chronic lymphocytic leukemia, hairy cell leukemia, acute lymphocytic leukemia (ALL) and Burkit's lymphoma) and is not present on the cell surface in early stages of B cell development or on to stem cells. In some embodiments, the antibodies, fragments, and variants thereof may be any of those taught in International Patent Publications, WO2016149578, WO2014065961, and WO2013059593A1 (the contents of each of which are incorporated by reference in its entirety). In some embodiments, antibodies with high affinity may be derived from any of the CD22 antibody heavy and light chain variables described in Table 10.

In some embodiments, the payloads of the present invention may include an antigen binding region comprising variable heavy chain and variable light chains with the amino acid sequences selected from those in Table 10.

TABLE 10

Variable Heavy and Light Chain Sequences

| Target | Description and Clone name | Source | Antibody chain | SEQ ID NO. |
|---|---|---|---|---|
| ALK | ALK15 VH | SEQ ID NO. 1 in WO2015069922 | VH | 4439 |
| ALK | ALK48 VH | SEQ ID NO. 3 in WO2015069922 | VH | 4440 |
| ALK | ALK53 VH | SEQ ID NO. 5 in WO2015069922 | VH | 4441 |
| ALK | ALK58 VH | SEQ ID NO. 7 in WO2015069922 | VH | 4442 |
| ALK | humanized ALK15 VH | SEQ ID NO. 9 in WO2015069922 | VH | 4443 |

TABLE 10-continued

Variable Heavy and Light Chain Sequences

| Target | Description and Clone name | Source | Antibody chain | SEQ ID NO. |
|---|---|---|---|---|
| ALK | humanized ALK48 VH | SEQ ID NO. 11 in WO2015069922 | VH | 4444 |
| ALK | humanized ALK53 VH | SEQ ID NO. 13 in WO2015069922 | VH | 4445 |
| ALK | humanized ALK58 VH | SEQ ID NO. 15 in WO2015069922 | VH | 4446 |
| ALK | ALK15 VL | SEQ ID NO. 2 in WO2015069922 | VL | 4447 |
| ALK | ALK48 VL | SEQ ID NO. 4 in WO2015069922 | VL | 4448 |
| ALK | ALK53 VL | SEQ ID NO. 6 in WO2015069922 | VL | 4449 |
| ALK | ALK58 VL | SEQ ID NO. 8 in WO2015069922 | VL | 4450 |
| ALK | humanized ALK15 VL | SEQ ID NO. 10 in WO2015069922 | VL | 4451 |
| ALK | humanized ALK48 VL | SEQ ID NO. 12 in WO2015069922 | VL | 4452 |
| ALK | humanized ALK53 VL | SEQ ID NO. 14 in WO2015069922 | VL | 4453 |
| ALK | humanized ALK58 VL | SEQ ID NO. 16 in WO2015069922 | VL | 4454 |
| CD22 | CD22 VL | SEQ ID NO. 14 in WO2016149578 | VL | 4455 |
| CD22 | CD22 (HA22 or BL22) VL | SEQ ID NO. 1 in WO2013059593 | VL | 4456 |
| CD22 | CD22 VH | SEQ ID NO. 13 in WO2016149578 | VH | 4457 |
| CD22 | CD22 (HA22 or BL22) VH | SEQ ID NO. 3 in WO2013059593 | VH | 4458 |
| CD22 | CD22 (HA22 or BL22) VH | SEQ ID NO. 4 in WO2013059593 | VH | 4459 |
| CD276 | CD276 VH | SEQ ID NO. 7 in WO2017044699 | VH | 4460 |
| CD276 | CD276 VH (CD276.6 (m856)) | SEQ ID NO. 7 in WO2014160627 | VH | 4461 |
| CD276 | CD276 VH (CD276.1 (m851)) | SEQ ID NO. 17 in WO2014160627 | VH | 4462 |
| CD276 | CD276 VH (CD276.17 (m8517)) | SEQ ID NO. 26 in WO2014160627 | VH | 4463 |
| CD276 | CD276 VL | SEQ ID NO. 8 in WO2017044699 | VL | 4464 |
| CD276 | CD276 VL (CD276.6 (m856)) | SEQ ID NO. 8 in WO2014160627 | VL | 4465 |
| CD276 | CD276 VL (CD276.1 (m851)) | SEQ ID NO. 18 in WO2014160627 | VL | 4466 |
| CD276 | CD276 VL (CD276.17 (m8517)) | SEQ ID NO. 27 in WO2014160627 | VL | 4467 |
| GD2 | 3F8 heavy chain variable | SEQ ID No. 1 in WO2011160119 | VH | 4468 |
| GD2 | 3F8 light chain variable | SEQ ID No. 2 in WO2011160119 | VL | 4469 |
| GD2 | 3F8 heavy chain variable | SEQ ID No. 3 in WO2011160119 | VH | 4470 |
| GD2 | humanized 3F8 heavy chain variable | SEQ ID No. 4 in WO2011160119 | VH | 4471 |
| GD2 | humanized 3F8 light chain variable | SEQ ID No. 5 in WO2011160119 | VL | 4472 |
| GD2 | humanized 3F8 heavy chain 2 variable | SEQ ID No. 6 in WO2011160119 | VH | 4473 |
| GD2 | humanized 3F8 light chain 2 variable | SEQ ID No. 7 in WO2011160119 | VL | 4474 |
| GD2 | humanized 3F8 heavy chain variable | SEQ ID No. 8 in WO2011160119 | VH | 4475 |
| GD2 | Human GD2 heavy chain variable | SEQ ID No. 16 in WO2010002822A1 | VH | 4476 |
| GD2 | Human GD2 light chain variable | SEQ ID No. 32 in WO2010002822A1 | VL | 4477 |
| GD2 | chimeric Ch3F8 heavy chain-gamma 1 | Cheung et al., Oncoimmunology, 2012, 1(4): 477-486 | VH | 4478 |
| GD2 | chimeric Ch3F8 light chain-kappa | Cheung et al., Oncoimmunology, 2012, 1(4): 477-486 | VL | 4479 |
| GD2 | humanized Hu3F8 heavy chain-gamma1 | Cheung et al., Oncoimmunology, 2012, 1(4): 477-486 | VH | 4480 |
| GD2 | humanized Hu3F8 light chain-kappa | Cheung et al., Oncoimmunology, 2012, 1(4): 477-486 | VL | 4481 |
| GD2 | Chimeric Ch3F8 heavy chain-gamma4 | Cheung et al., Oncoimmunology, 2012, 1(4): 477-486 | VH | 4482 |
| GD2 | humanized Hu3F8 heavy chain-gamma4 | Cheung et al., Oncoimmunology, 2012, 1(4): 477-486 | VL | 4483 |
| GD2 | GD2 VH | SEQ ID NO. 17 in WO2016134284 | VH | 4484 |
| GD2 | GD2 VL | SEQ ID NO. 18 in WO2016134285 | VL | 4485 |
| GD2 | Murine KM666 VH (heavy chain variable region) sequence | SEQ ID NO. 9 in WO2015132604 | VH | 4486 |
| GD2 | Humanized KM666 VH sequence | SEQ ID NO. 10 in WO2015132604 | VH | 4487 |
| GD2 | Murine KM666 VL (light chain variable region) sequence | SEQ ID NO. 11 in WO2015132604 | VL | 4488 |
| GD2 | Humanized KM666 VL sequence | SEQ ID NO. 12 in WO2015132604 | VL | 4489 |
| GD2 | GD2 VL | SEQ ID NO. 1 in US20040203100 | VL | 4490 |

TABLE 10-continued

Variable Heavy and Light Chain Sequences

| Target | Description and Clone name | Source | Antibody chain | SEQ ID NO. |
|---|---|---|---|---|
| GD2 | GD2 VH | SEQ ID NO. 2 in US20040203100 | VH | 4491 |
| GD2 | Murine KM666 VH (heavy chain variable region) sequence | SEQ ID NO. 9 in US20170066838 | VH | 4492 |
| GD2 | Humanized KM666 VH sequence | SEQ ID NO. 10 in US20170066838 | VH | 4493 |
| GD2 | Murine KM666 VL (light chain variable region) sequence | SEQ ID NO. 11 in US20170066838 | VL | 4494 |
| GD2 | Humanized KM666 VL sequence | SEQ ID NO. 12 in US20170066838 | VL | 4495 |
| GD2 | GD2 VL | SEQ ID NO. 3 in US20160304620 | VL | 4496 |
| GD2 | GD2 VH | SEQ ID NO. 4 in US20160304620 | VH | 4497 |
| GD2 | GD2 VH | SEQ ID NO. 2 in US20150353645 | VH | 4498 |
| GD2 | GD2 VL | SEQ ID NO. 4 in US20150353645 | VL | 4499 |
| GD2 | GD2 VH | SEQ ID NO. 6 in US20150353645 | VH | 4500 |
| GD2 | GD2 VL | SEQ ID NO. 8 in US20150353645 | VL | 4501 |
| GD2 | GD2 VH | SEQ ID NO. 10 in US20150353645 | VH | 4502 |
| GD2 | GD2 VL | SEQ ID NO. 12 in US20150353645 | VL | 4503 |
| GD2 | GD2 VH | SEQ ID NO. 14 in US20150353645 | VH | 4504 |
| GD2 | GD2 VL | SEQ ID NO. 16 in US20150353645 | VL | 4505 |
| GD2 | GD2 VH | SEQ ID NO. 18 in US20150353645 | VH | 4506 |
| GD2 | GD2 VL | SEQ ID NO. 20 in US20150353645 | VL | 4507 |
| GD2 | GD2 VH | SEQ ID NO. 22 in US20150353645 | VH | 4508 |
| GD2 | GD2 VL | SEQ ID NO. 24 in US20150353645 | VL | 4509 |
| GD2 | GD2 VH | SEQ ID NO. 26 in US20150353645 | VH | 4510 |
| GD2 | GD2 VL | SEQ ID NO. 28 in US20150353645 | VL | 4511 |
| GD2 | GD2 VH | SEQ ID NO. 30 in US20150353645 | VH | 4512 |
| GD2 | GD2 VL | SEQ ID NO. 32 in US20150353645 | VL | 4513 |
| GD2 | GD2 VH | SEQ ID NO. 34 in US20150353645 | VH | 4514 |
| GD2 | GD2 VH | SEQ ID NO. 36 in US20150353645 | VH | 4515 |
| GD2 | GD2 VL | SEQ ID NO. 38 in US20150353645 | VL | 4516 |
| GD2 | GD2 VH | SEQ ID NO. 40 in US20150353645 | VH | 4517 |
| GD2 | GD2 VL | SEQ ID NO. 42 in US20150353645 | VL | 4518 |
| GD2 | GD2 VL | SEQ ID NO. 3 in US20150139942 | VL | 4519 |
| GD2 | GD2 VH | SEQ ID NO. 4 in US20150139942 | VH | 4520 |
| GD2 | GD2 VL | SEQ ID NO. 7 in US20150139942 | VL | 4521 |
| GD2 | GD2 VH | SEQ ID NO. 8 in US20150139942 | VH | 4522 |
| GD2 | GD2 VH | SEQ ID NO. 16 in US20130287691 | VH | 4523 |
| GD2 | GD2 VL | SEQ ID NO. 32 in US20130287691 | VL | 4524 |
| GD2 | GD2 VH | SEQ ID NO. 40 in US20130287691 | VH | 4525 |
| GD2 | GD2 VL | SEQ ID NO. 42 in US20130287691 | VL | 4526 |
| GD2 | GD2 VL | SEQ ID NO. 3 in US20140134162 | VL | 4527 |
| GD2 | GD2 VH | SEQ ID NO. 4 in US20140134162 | VH | 4528 |
| GD2 | GD2 VH | SEQ ID NO. 20 in WO2017055385 | VH | 4529 |
| GD2 | GD2 VL | SEQ ID NO. 20 in WO2017055385 | VL | 4530 |
| GD2 | GD2 VH | SEQ ID NO. 3 in WO2013189516 | VH | 4531 |
| GD2 | GD2 VL | SEQ ID NO. 4 in WO2013189516 | VL | 4532 |
| GD2-0-acetylated | KM8B6 GD2-0-acetylated heavy chain variable | SEQ ID No. 1 in WO2008043777 | VH | 4533 |
| GD2-0-acetylated | KM8B6 GD2-0-acetylated light chain variable | SEQ ID No. 2 in WO2008043777 | VL | 4534 |
| GD2-0-acetylated | O-acetylated-GD2 ganglioside light chain variable region | SEQ ID No. 6 in WO2015067375 | VL | 4535 |
| GD2-0-acetylated | O-acetylated-GD2 ganglioside heavy chain variable region | SEQ ID No. 7 in WO2015067375 | VH | 4536 |
| GD2-0-acetylated | GD2 VL | SEQ ID NO. 7 in US20160068608 | VL | 4537 |
| GD2-0-acetylated | GD2 VH | SEQ ID NO. 8 in US20160068608 | VH | 4538 |
| GD2-0-acetylated | GD2 VL (8B6) | SEQ ID NO. 7 in WO2014177271A1 | VL | 4539 |
| GD2-0-acetylated | GD2 VH (8B6) | SEQ ID NO. 8 in WO2014177271A1 | VH | 4540 |
| GD2-0-acetylated | GD2 VL | SEQ ID NO. 9 in WO2014177271A1 | VL | 4541 |
| GD2-0-acetylated | GD2 VH | SEQ ID NO. 10 in WO2014177271A1 | VH | 4542 |
| Gangliosides (including GD2) | GMab1-VH | SEQ ID No. 11 in WO2012071216 | VH | 4543 |

TABLE 10-continued

Variable Heavy and Light Chain Sequences

| Target | Description and Clone name | Source | Antibody chain | SEQ ID NO. |
|---|---|---|---|---|
| Gangliosides (including GD2) | GMab1-VH | SEQ ID No. 12 in WO2012071216 | VL | 4544 |
| Gangliosides (including GD2) | GMab1-VL | SEQ ID No. 13 in WO2012071216 | VH | 4545 |
| Gangliosides (including GD2) | GMab2-VH | SEQ ID No. 14 in WO2012071216 | VL | 4546 |
| CD33 | Anti CD33 VH (Clone M195) | SEQ ID NO. 11 in WO2015150526 | VH | 4547 |
| CD33 | Anti CD33 VL (Clone M195) | SEQ ID NO. 12 in WO2015150526 | VL | 4548 |
| CD33 | Anti CD33 VH (Clone M2H12) | SEQ ID NO. 13 in WO2015150526 | VH | 4549 |
| CD33 | Anti CD33 VL (Clone M2H12) | SEQ ID NO. 14 in WO2015150526 | VL | 4550 |
| CD33 | Anti CD33 VH (Clone DRB2) | SEQ ID NO. 15 in WO2015150526 | VH | 4551 |
| CD33 | Anti CD33 VL (Clone DRB2) | SEQ ID NO. 16 in WO2015150526 | VL | 4552 |
| CD33 | Anti CD33 VH (Clone My9-6) | SEQ ID NO. 17 in WO2015150526 | VH | 4553 |
| CD33 | Anti CD33 VL (Clone My9-6) | SEQ ID NO. 18 in WO2015150526 | VL | 4554 |
| BCMA | BCMA VH (Clone BCMA-50) | SEQ ID NO. 11 in WO2015158671 | VH | 4555 |
| BCMA | BCMA VL (Clone BCMA-50) | SEQ ID NO. 12 in WO2015158672 | VL | 4556 |
| BCMA | BCMA VH (Clone BCMA-30) | SEQ ID NO. 13 in WO2015158673 | VH | 4557 |
| BCMA | BCMA VL (Clone BCMA-30) | SEQ ID NO. 14 in WO2015158674 | VL | 4558 |
| BCMA | BCMA VH (Clone C11D5.3) | SEQ ID NO. 15 in WO2015158675 | VH | 4559 |
| BCMA | BCMA VL (Clone C11D5.3) | SEQ ID NO. 16 in WO2015158676 | VL | 4560 |
| BCMA | BCMA VH (Clone C13F12.1) | SEQ ID NO. 17 in WO2015158677 | VH | 4561 |
| BCMA | BCMA VL (Clone C13F12.1) | SEQ ID NO. 18 in WO2015158678 | VL | 4562 |
| Her2 | Trastuzumab (Herceptin) | SEQ ID NO. 1 in WO2017093844 | VH | 4563 |
| Her2 | Trastuzumab (Herceptin) | SEQ ID NO. 7 in WO2017093844 | VL | 4564 |
| Her2 | huMAb4D5-5 | SEQ ID NO. 1 in U.S. Pat. No. 8,075,890 | VL | 4565 |
| Her2 | huMAb4D5-5 | SEQ ID NO. 2 in U.S. Pat. No. 8,075,890 | VH | 4566 |
| Her2 | a consensus antibody variable domain | SEQ ID NO. 3 in U.S. Pat. No. 8,075,890 | VL | 4567 |
| Her2 | a consensus antibody variable domain | SEQ ID NO. 4 in U.S. Pat. No. 8,075,890 | VH | 4568 |
| Her2 | muMAb4D5 | SEQ ID NO. 5 in U.S. Pat. No. 8,075,890 | VL | 4569 |
| Her2 | muMAb4D5 | SEQ ID NO. 6 in U.S. Pat. No. 8,075,890 | VH | 4570 |
| Her2 | N29 | No SEQ ID in WO1993003741 | VH | 4571 |
| Her2 | N29 | No SEQ ID in WO1993003741 | VL | 4572 |
| Her2 | 2C4 | SEQ ID NO. 1 in U.S. Pat. No. 7,981,418 | VL | 4573 |
| Her2 | 2C4 | SEQ ID NO. 2 in U.S. Pat. No. 7,981,418 | VH | 4574 |
| Her2 | variant 574/Pertuzumab | SEQ ID NO. 3 in U.S. Pat. No. 7,981,418 | VL | 4575 |
| Her2 | variant 574/Pertuzumab | SEQ ID NO. 4 in U.S. Pat. No. 7,981,418 | VH | 4576 |
| Her2 | human VL consensus (hum. kappa. 1, light kappa subgroup 1) | SEQ ID NO. 5 in U.S. Pat. No. 7,981,418 | VL | 4577 |
| Her2 | human VH consensus (humIII, heavy subgroup III) | SEQ ID NO. 6 in U.S. Pat. No. 7,981,418 | VH | 4578 |
| Her2 | Pertuzumab | SEQ ID NO. 13 in U.S. Pat. No. 7,981,418 | VL | 4579 |
| Her2 | Pertuzumab | SEQ ID NO. 14 in U.S. Pat. No. 7,981,418 | VH | 4580 |
| Her2 | trastuzumab/humMAb4D5-8 | SEQ ID NO. 15 in U.S. Pat. No. 7,981,418 | VL | 4581 |
| Her2 | trastuzumab/humMAb4D5-8 | SEQ ID NO. 16 in U.S. Pat. No. 7,981,418 | VH | 4582 |
| Her2 | a variant Pertuzumab light chain sequence | SEQ ID NO. 17 in U.S. Pat. No. 7,981,418 | VL | 4583 |
| Her2 | a variant Pertuzumab heavy chain sequence | SEQ ID NO. 18 in U.S. Pat. No. 7,981,418 | VH | 4584 |
| Her2 | 3. F2 monoclonal antibody | SEQ ID NO. 2 in WO2001009187 | VH | 4585 |

TABLE 10-continued

Variable Heavy and Light Chain Sequences

| Target | Description and Clone name | Source | Antibody chain | SEQ ID NO. |
|---|---|---|---|---|
| Her2 | 3. F2 monoclonal antibody | SEQ ID NO. 4 in WO2001009187 | VL | 4586 |
| Her2 | 1. D2 monoclonal antibody | SEQ ID NO. 6 in WO2001009187 | VH | 4587 |
| Her2 | 1. D2 monoclonal antibody | SEQ ID NO. 8 in WO2001009187 | VL | 4588 |
| Her2 | 2. E8 monoclonal antibody | SEQ ID NO. 10 in WO2001009187 | VH | 4589 |
| Her2 | 2. E8 monoclonal antibody | SEQ ID NO. 12 in WO2001009187 | VL | 4590 |
| Her2 | 2C4 | SEQ ID NO. 4 in U.S. Pat. No. 7,097,840 | VL | 4591 |
| Her2 | variant 574/Pertuzumab | SEQ ID NO. 5 in U.S. Pat. No. 7,097,840 | VL | 4592 |
| Her2 | human VL subgroup | SEQ ID NO. 6 in U.S. Pat. No. 7,097,840 | VL | 4593 |
| Her2 | 4D5 | SEQ ID NO. 14 in WO2003068801 | VH | 4594 |
| Her2 | Hu4D5-8 | SEQ ID NO. 1 in WO2003087131 | VL | 4595 |
| Her2 | rhuMAb | SEQ ID NO. 50 in US20040254108 | VH | 4596 |
| Her2 | rhuMAb | SEQ ID NO. 52 in US20040254108 | VL | 4597 |
| Her2 | her2VHCH - SM5-1 VH; human kappa chain constant (CH) | SEQ ID NO. 54 in US20040254108 | VH | 4598 |
| Her2 | her2VLCL - SM5-1 VL; human kappa chain constant (CL) | SEQ ID NO. 56 in US20040254108 | VL | 4599 |
| Her2 | her2VH/Fc/FL- rhuMAb VH; IgG1 Fc; Flt3 ligand extracellular region (hFLex) | SEQ ID NO. 58 in US20040254108 | VH | 4600 |
| Her2 | her2VH/Fc/Link/FL - rhuMAb; IgG1 Fc; linker; Flt3 ligand extracellular region (hFLex) | SEQ ID NO. 60 in US20040254108 | VH | 4601 |
| Her2 | Herceptin Fab | SEQ ID NO. 9 in US20050260711A1 | VL | 4602 |
| Her2 | Herceptin Fab | SEQ ID NO. 10 in US20050260711A1 | VH | 4603 |
| Her2 | Pertuzumab with a signal peptide sequence | SEQ ID NO. 17 in US20060018899 | VL | 4604 |
| Her2 | Pertuzumab with a signal peptide sequence | SEQ ID NO. 18 in US20060018899 | VH | 4605 |
| Her2 | Periplasmic Fab-4D5 | SEQ ID NO. 30 in U.S. Pat. No. 7,632,924 | VL | 4606 |
| Her2 | Periplasmic Fab-4D5 | SEQ ID NO. 31 in U.S. Pat. No. 7,632,924 | VH | 4607 |
| Her2 | trastuzumab A88C | SEQ ID NO. 6 in U.S. Pat. No. 7,521,541 | VH | 4608 |
| Her2 | trastuzumab A121C | SEQ ID NO. 7 in U.S. Pat. No. 7,521,541 | VH | 4609 |
| Her2 | trastuzumab V110C | SEQ ID NO. 8 in U.S. Pat. No. 7,521,541 | VL | 4610 |
| Her2 | B1D2 | SEQ ID NO. 42 in U.S. Pat. No. 7,332,585 | VH | 4611 |
| Her2 | B1D2 | SEQ ID NO. 47 in U.S. Pat. No. 7,332,585 | VL | 4612 |
| Her2 | Fab63 | SEQ ID NO. 7 in US20100047230 | VH | 4613 |
| Her2 | Fab63 | SEQ ID NO. 8 in US20100047230 | VL | 4614 |
| Her2 | Herceptin | SEQ ID NO. 3 in US20160256561 | VH | 4615 |
| Her2 | anti-her2/neu antibody with a signal peptide | SEQ ID NO. 1 in U.S. Pat. No. 9,534,057 | VH | 4616 |
| Her2 | anti-her2/neu antibody with a signal peptide | SEQ ID NO. 2 in U.S. Pat. No. 9,534,057 | VL | 4617 |
| anti-Her2/neu - anti-CD3 | anti-Her2/neu - anti-CD3 bispecific antibody VH | SEQ ID NO. 3 in WO2014079000A1 | VH | 4618 |

3. Therapeutic Agents

In some embodiments, payloads of the present invention may be a therapeutic agent, such as a cancer therapeutic agent, an immunotherapeutic agent, an anti-pathogen agent or a gene therapy agent. In some aspects, the immunotherapeutic agent may be a TCR receptor, a chimeric antigen receptor (CAR), a chimeric switch receptor, an antagonist of a co-inhibitory molecule, an agonist of a co-stimulatory molecule, a cytokine, a cytokine receptor, a chemokine, a chemokine receptor, a metabolic factor, a homing receptor and a safety switch.

In some embodiments, payloads of the present invention may be chimeric antigen receptors (CARs) which when transduced into immune cells (e.g., T cells and NK cells), can re-direct the immune cells against the target (e.g., a tumor cell) which expresses a molecule recognized by the extracellular target moiety of the CAR.

As used herein, the term "chimeric antigen receptor (CAR)" refers to a synthetic receptor that mimics TCR on the surface of T cells. In general, a CAR is composed of an extracellular targeting domain, a transmembrane domain/region and an intracellular signaling/activation domain. Cells such as T cells engineered to express a CAR can be redirected to attack target cells that express a molecule which can be recognized by the targeting moiety of the CAR. In a standard CAR receptor, the components: the extracellular targeting domain, transmembrane domain and intracellular signaling/activation domain, are linearly constructed as a single fusion protein. The extracellular region comprises a targeting domain/moiety (e.g., a scFv) that recognizes a specific tumor antigen or other tumor cell-surface molecules. The intracellular region may contain a signaling domain of TCR complex (e.g., the signal region of CD3c), and/or one or more costimulatory signaling domains, such as those from CD28, 4-1BB (CD137) and OX-40 (CD134). For example, a "first-generation CAR" only has the CD3ζ signaling domain, whereas in an effort to augment T-cell persistence and proliferation, costimulatory intracellular domains are added, giving rise to second generation CARs having a CD3ζ signal domain plus one costimulatory signaling domain, and third generation CARs having CD3ζ signal domain plus two or more costimulatory signaling domains. A CAR, when expressed by a T cell, endows the T cell with antigen specificity determined by the extracellular targeting moiety of the CAR. Recently, it is also desirable to add one or more elements such as homing and suicide genes to develop a more competent and safer architecture of CAR, so called the fourth-generation CAR.

A CAR may be capable of binding to a tumor specific antigen selected from 5T4, 707-AP, A33, AFP (α-fetoprotein), AKAP-4 (A kinase anchor protein 4), ALK, α5β1-integrin, androgen receptor, annexin II, alpha-actinin-4, ART-4, B1, B7H3, B7H4, BAGE (B melanoma antigen), BCMA, BCR-ABL fusion protein, beta-catenin, BKT-antigen, BTAA, CA-I (carbonic anhydrase I), CA50 (cancer antigen 50), CA125, CA15-3, CA195, CA242, calretinin, CAIX (carbonic anhydrase), CAMEL (cytotoxic T-lymphocyte recognized antigen on melanoma), CAM43, CAP-1, Caspase-8/m, CD4, CD5, CD7, CD19, CD20, CD22, CD23, CD25, CD27/m, CD28, CD30, CD33, CD34, CD36, CD38, CD40/CD154, CD41, CD44v6, CD44v7/8, CD45, CD49f, CD56, CD68KP1, CD74, CD79a/CD79b, CD103, CD123, CD133, CD138, CD171, cdc27/m, CDK4 (cyclin dependent kinase 4), CDKN2A, CDS, CEA (carcinoembryonic antigen), CEACAM5, CEACAM6, chromogranin, c-Met, c-Myc, coa-1, CSAp, CT7, CT10, cyclophilin B, cyclin B1, cytoplasmic tyrosine kinases, cytokeratin, DAM-10, DAM-6, dek-can fusion protein, desmin, DEPDC1 (DEP domain containing 1), E2A-PRL, EBNA, EGF-R (epidermal growth factor receptor), EGP-1 (epithelial glycoprotein-1) (TROP-2), EGP-2, EGP-40, EGFR (epidermal growth factor receptor), EGFRvIII, EF-2, ELF2M, EMMPRIN, EpCAM (epithelial cell adhesion molecule), EphA2, Epstein Barr virus antigens, Erb (ErbB 1; ErbB3; ErbB4), ETA (epithelial tumor antigen), ETV6-AML1 fusion protein, FAP (fibroblast activation protein), FBP (folate-binding protein), FGF-5, folate receptor a, FOS related antigen 1, fucosyl GM1, G250, GAGE (GAGE-1; GAGE-2), galactin, GD2 (ganglioside), GD3, GFAP (glial fibrillary acidic protein), GM2 (oncofetal antigen-immunogenic-1; OFA-I-1), GnT-V, Gp100, H4-RET, HAGE (helicase antigen), HER-2/neu, HIFs (hypoxia inducible factors), HIF-1α, HIF-2α, HLA-A2, HLA-A*0201-R170I, HLA-Al 1, HMWMAA, Hom/Mel-40, HSP70-2M (Heat shock protein 70), HST-2, HTgp-175, hTERT (or hTRT), human papillomavirus-E6/human papillomavirus-E7 and E6, iCE (immune-capture EIA), IGF-1R, IGH-IGK, IL2R, IL5, ILK (integrin-linked kinase), IMP3 (insulin-like growth factor II mRNA-binding protein 3), IRF4 (interferon regulatory factor 4), KDR (kinase insert domain receptor), KIAA0205, KRAB-zinc finger protein (KID)-3; KID31, KSA (17-1A), K-ras, LAGE, LCK, LDLR/FUT (LDLR-fucosyltransferaseAS fusion protein), LeY (Lewis Y), MAD-CT-1, MAGE (tyrosinase, melanoma-associated antigen) (MAGE-1; MAGE-3), melan-A tumor antigen (MART), MART-2/Ski, MC1R (melanocortin 1 receptor), MDM2, mesothelin, MPHOSPH1, MSA (muscle-specific actin), mTOR (mammalian targets of rapamycin), MUC-1, MUC-2, MUM-1 (melanoma associated antigen (mutated) 1), MUM-2, MUM-3, Myosin/m, MYL-RAR, NA88-A, N-acetylglucosaminyltransferase, neo-PAP, NF-KB (nuclear factor-kappa B), neurofilament, NSE (neuron-specific enolase), Notch receptors, NuMa, N-Ras, NY-BR-1, NY-CO-1, NY-ESO-1, Oncostatin M, OS-9, OY-TES1, p53 mutants, p190 minor bcr-abl, pl5(58), pl85erbB2, pl80erbB-3, PAGE (prostate associated gene), PAP (prostatic acid phosphatase), PAX3, PAX5, PDGFR (platelet derived growth factor receptor), cytochrome P450 involved in piperidine and pyrrolidine utilization (PIPA), Pml-RAR alpha fusion protein, PR-3 (proteinase 3), PSA (prostate specific antigen), PSM, PSMA (Prostate stem cell antigen), PRAME (preferentially expressed antigen of melanoma), PTPRK, RAGE (renal tumor antigen), Raf (A-Raf, B-Raf and C-Raf), Ras, receptor tyrosine kinases, RCAS1, RGSS, ROR1 (receptor tyrosine kinase-like orphan receptor 1), RU1, RU2, SAGE, SART-1, SART-3, SCP-1, SDCCAG16, SP-17 (sperm protein 17), src-family, SSX (synovial sarcoma X breakpoint)-1, SSX-2(HOM-MEL-40), SSX-3, SSX-4, SSX-5, STAT-3, STAT-5, STAT-6, STEAD, STn, survivin, syk-ZAP70, TA-90 (Mac-2 binding protein\cyclophilin C-associated protein), TAAL6, TACSTD1 (tumor associated calcium signal transducer 1), TACSTD2, TAG-72-4, TAGE, TARP (T cell receptor gamma alternate reading frame protein), TEL/AML1 fusion protein, TEM1, TEM8 (endosialin or CD248), TGFβ, TIE2, TLP, TMPRSS2 ETS fusion gene, TNF-receptor (TNF-α receptor, TNF-β receptor; or TNF-γ receptor), transferrin receptor, TPS, TRP-1 (tyrosine related protein 1), TRP-2, TRP-2/INT2, TSP-180, VEGF receptor, WNT, WT-1 (Wilm's tumor antigen) and XAGE.

Exemplary CAR constructs may include a CAR targeting mesothelin (U.S. Pat. Nos. 9,272,002 and 9,359,447); EGFRvIII specific CARs in U.S. Pat. No. 9,266,960; anti-TAG CARs in U.S. Pat. No. 9,233,125; CD19 CARs in US Patent Publication NO. 2016/014533; CD19 CAR having the amino acid sequence of SEQ ID NO. 24 of U.S. Pat. No. 9,328,156; CD19 CARs in U.S. Pat. Nos. 8,911,993, 8,975,071, 9,101,584, 9,102,760, and 9,102,761; BCMA (CD269) specific CARs disclosed in International Patent Publication NOs. WO2016/014565 and WO2016/014789; CLL-1 (C-type lectin-like molecule 1) CARs comprising the amino acid sequences of SEQ ID NOs. 99, 96, 100, 101, 102, 91, 92, 93, 94, 95, 97, 98, 103, and 197 disclosed in International Patent Publication NO. WO2016/014535; CD33 specific CARs comprising the amino acid sequences of SEQ ID NOs. 48-56 in International Patent Publication NO. WO2016/014576; CD33 specific CARs comprising the amino acid sequences of SEQ ID NOs. 19-22, 27-30 and 35-38 in International Patent Publication NO. WO2015/150526; CD37 specific CARs encoded by the nucleic acids of SEQ ID NOs. 1-5 in US patent publication NO. US2015/0329640; GPC3 CAR (International patent publication NO. WO2016/036973), GFRalpha 4 CARs having the amino acid sequences of SEQ ID NOs. 85, 86, 90, 92, 94, 96, 98, 100, 102, and 104 in International Patent Publication NO. WO2016/025880; CD123 CARs comprising the amino acid sequences of SEQ ID NOs. 98, 99, 100 and 101 in International Patent Publication NOs. WO2016/028896; CD123 specific multi-chain CARs in International Patent Publication NO. WO2015/193406; ROR-1 specific CARs comprising the amino acid sequences of SEQ ID NOs. 93, 95 and 117 in International Patent Publication NO. WO2016/016344; ROR-1 specific multi-chain CARs in International patent publication NO. WO2016/016343; trophoblast glycoprotein (5T4, TPBG) specific CARs comprising the amino acid sequences of SEQ ID NOs. 21, 27, 33, 39, 23, 29, 34, 41, 19, 25, 31, 37, 20, 26, 32, 38, 22, 28, 34, 40, 24, 30, 36 and 42 in International Patent Publication NO. WO2016/034666; EGFRvIII specific CARs comprising the amino acid sequences of SEQ ID NOs. 15, 17, 24, 25, 26 and 27 in International Patent Publication NO. WO2016016341; a TEM 8 CAR comprising the amino acid sequence of SEQ ID NO. 1 in International Patent Publication NO. WO2014164544, a TEM1 CAR comprising the amino acid sequence of SEQ ID NO. 2 in International Patent Publication NO. WO2014164544; GPC-3 CAR having the amino acid sequences of SEQ ID NOs. 3 and 26 in International Patent Publication NO. WO2016/049459; a chondroitin sulfate proteoglycan-4 (CSPG4) CAR in International Patent Publication NO. WO2015/080981; Kappa/lambda CARs in International Patent Publication NO. WO2015/164739; the contents of each of which are incorporated herein by reference in their entirety.

In some embodiments, the CAR constructs may include CAIX (carboxy-anhydrase-IX (CAIX) specific CAR (Lamers et al., *Biochem Soc Trans,* 2016, 44(3): 951-959), HIV-1 specific CAR (Ali et al., *J Virol.,* 2016, May 25, pii: JVI.00805-16), CD20 specific CAR (Rufener et al., *Cancer Immunol. Res.,* 2016, 4(6): 509-519), a CD20/CD19 bispecific CAR (Zah et al., *Cancer Immunol Res.,* 2016, 4(6): 498-508), and EGFR specific CARs; the contents of each of which are incorporated herein by reference in their entirety.

In one embodiment of the present invention, the payload of the invention is a CD19 specific CAR operably linked to human DHFR DD. In some embodiments, the amino acid sequences of the CD19 CAR may comprise the components and sequences listed in Table 11. Nucleic acid sequences encoding the amino acid sequences are also described in Table 11. In the Table, the transmembrane domain is underlined to differentiate it from the adjacent sequence components. In Table 11, the amino acid sequences may comprise a stop codon at the end which is denoted in the table with a "*". In the Table 11, constructs OT-CD19N-008 to OT-CD19-011 are driven by a CMV promoter and constructs OT-CD19-014 and 015 are driven by an EF1a promoter. The position of the mutated amino acids listed in Table 11 is relative to the wildtype human DHFR (Uniprot ID: P00374) of SEQ ID NO. 1.

TABLE 11

Amino acid sequences of the CD19 CAR and its components

| Description | Amino Acid Sequence | Amino Acid SEQ ID NO | Nucleic Acid SEQ ID NO or Sequence |
|---|---|---|---|
| CD19 scFv | DIQMTQTTSSLSASLGDRVTISCRASQDISKYLNW YQQKPDGTVKLLIYHTSRLHSGVPSRFSGSGSGTD YSLTISNLEQEDIATYFCQQGNTLPYTFGGGTKLEI TGGGGSGGGGSGGGGSEVKLQESGPGLVAPSQSL SVTCTVSGVSLPDYGVSWIRQPPRKGLEWLGVIW GSETTYYNSALKSRLTIIKDNSKSQVFLKMNSLQT DDTAIYYCAKHYYYGGSYAMDYWGQGTSVTVSS | 1294 | 4619-4623 |
| CD8α hinge + TM | TTTPAPRPPTPAPTIASQPLSLRPEACRPAAGGAVH TRGLDFACDIYIWAPLAGTCGVLLLSLVITLYC | 1300 | 4624 |
| CD8α hinge | TTTPAPRPPTPAPTIASQPLSLRPEACRPAAGGAVH TRGLDFACD | 1302 | 4625-4629 |
| CD3 zeta signaling domain | RVKFSRSADAPAYKQGQNQLYNELNLGRREEYD VLDKRRGRDPEMGGKPRRKNPQEGLYNELQKDK MAEAYSEIGMKGERRRGKGHDGLYQGLSTATKD TYDALHMQALPPR | 1308 | 4630-4634 |
| 4-1BB intracellular signaling domain | KRGRKKLLYIFKQPFMRPVQTTQEEDGCSCRFPEE EEGGCEL | 1314 | 4635-4639 |
| CD8α leader | MALPVTALLLPLALLLHAARP | 1320 | 4640-4644 4645-4647 |
| Linker | GGSGG | 1329 | 1331, 4648-4651 |
| Linker | SG | — | |
| Modified Furin | ESRRVRRNKRSK | 1336 | 4652-4654 |
| hDHFR (Amino acid 2-187 of WT)(Y122I) | VGSLNIVAVSQNMGIGKNGDLPWPPLRNEFRYF QRMTTTSSVEGKQNLVIMGKKTWFSIPEKNRPLK GRINLVLSRELKEPPQGAHFLSRSLDDALKLTEQP ELANKVDMVWIVGGSSVIKEAMNHPGHLKLFVT RIMQDFESDTFFPEIDLEKYKLLPEYPGVLSDVQEE KGIKYKFEVYEKND | 13 | 4655 |

TABLE 11-continued

Amino acid sequences of the CD19 CAR and its components

| Description | Amino Acid Sequence | Amino Acid SEQ ID NO | Nucleic Acid SEQ ID NO or Sequence |
|---|---|---|---|
| hDHFR (Amino acid 2-187 of WT)(Y122I, A125F) | VGSLNCIVAVSQNMGIGKNGDLPWPPLRNEFRYF QRMTTTSSVEGKQNLVIMGKKTWFSIPEKNRPLK GRINLVLSRELKEPPQGAHFLSRSLDDALKLTEQP ELANKVDMVWIVGGSSVIKEFMNHPGHLKLFVTR IMQDFESDTFFPEIDLEKYKLLPEYPGVLSDVQEEK GIKYKFEVYEKND | 41 | 4656 |
| hDHFR (Amino acid 2-187 of WT)(Q36K, Y122I) | VGSLNCIVAVSQNMGIGKNGDLPWPPLRNEFRYF KRMTTTSSVEGKQNLVIMGKKTWFSIPEKNRPLK GRINLVLSRELKEPPQGAHFLSRSLDDALKLTEQP ELANKVDMVWIVGGSSVIKEAMNHPGHLKLFVT RIMQDFESDTFFPEIDLEKYKLLPEYPGVLSDVQEE KGIKYKFEVYEKND | 38 | 4657 |
| hDHFR (Amino acid 2-187 of WT)(Q36F, N65F, Y122I) | VGSLNCIVAVSQNMGIGKNGDLPWPPLRNEFRYF FRMTTTSSVEGKQNLVIMGKKTWFSIPEKFRPLKG RINLVLSRELKEPPQGAHFLSRSLDDALKLTEQPEL ANKVDMVWIVGGSSVIKEAMNHPGHLKLFVTRI MQDFESDTFFPEIDLEKYKLLPEYPGVLSDVQEEK GIKYKFEVYEKND | 56 | 4658 |
| OT-CD19-008 (OT-CD19C-008)(CD8a leader; CD19 scFv; CD8a hinge + TM; 41BB; CD3zeta; linker; (GGSGG (SEQ ID NO: 2729)); hDHFR (Amino acid 2-187 of WT)(Y122I); stop) | MALPVTALLLPLALLLHAARPDIQMTQTTSSLSAS LGDRVTISCRASQDISKYLNWYQQKPDGTVKLLIY HTSRLHSGVPSRFSGSGSGTDYSLTISNLEQEDIAT YFCQQGNTLPYTFGGGTKLEITGGGGSGGGGSGG GGSEVKLQESGPGLVAPSQSLSVTCTVSGVSLPDY GVSWIRQPPRKGLEWLGVIWGSETTYYNSALKSR LTIIKDNSKSQVFLKMNSLQTDDTAIYYCAKHYY YGGSYAMDYWGQGTSVTVSSTTTPAPRPPTPAPTI ASQPLSLRPEACRPAAGGAVHTRGLDFACDIYIW APLAGTCGVLLLSLVITLYCKRGRKKLLYIFKQPF MRPVQTTQEEDGCSCRFPEEEEGGCELRVKFSRSA DAPAYKQGQNQLYNELNLGRREEYDVLDKRRGR DPEMGGKPRRKNPQEGLYNELQKDKMAEAYSEI GMKGERRRGKGHDGLYQGLSTATKDTYDALHM QALPPRGGSGGVGSLNCIVAVSQNMGIGKNGDLP WPPLRNEFRYFQRMTTTSSVEGKQNLVIMGKKT WFSIPEKNRPLKGRINLVLSRELKEPPQGAHFLSRS LDDALKLTEQPELANKVDMVWIVGGSSVIKEAM NHPGHLKLFVTRIMQEDFESDTFFPEIDLEKYKLLPE YPGVLSDVQEEKGIKYKFEVYEKND* | 1340 | 4659 |
| OT-CD19-009 (OT-CD19C-009)(CD8a leader; CD19 scFv; CD8a hinge + TM; 41BB; CD3zeta; linker; hDHFR(Amino acid 2-187 of WT)(Y122I, A125F); stop) | MALPVTALLLPLALLLHAARPDIQMTQTTSSLSAS LGDRVTISCRASQDISKYLNWYQQKPDGTVKLLIY HTSRLHSGVPSRFSGSGSGTDYSLTISNLEQEDIAT YFCQQGNTLPYTFGGGTKLEITGGGGSGGGGSGG GGSEVKLQESGPGLVAPSQSLSVTCTVSGVSLPDY GVSWIRQPPRKGLEWLGVIWGSETTYYNSALKSR LTIIKDNSKSQVFLKMNSLQTDDTAIYYCAKHYY YGGSYAMDYWGQGTSVTVSSTTTPAPRPPTPAPTI ASQPLSLRPEACRPAAGGAVHTRGLDFACDIYIW APLAGTCGVLLLSLVITLYCKRGKKLLYIFKQPF MRPVQTTQEEDGCSCRFPEEEEGGCELRVKFSRSA DAPAYKQGQNQLYNELNLGRREEYDVLDKRRGR DPEMGGKPRRKNPQEGLYNELQKDKMAEAYSEI GMKGERRRGKGHDGLYQGLSTATKDTYDALHM QALPPRGGSGGVGSLNCIVAVSQNMGIGKNGDLP WPPLRNEFRYFQRMTTTSSVEGKQNLVIMGKKT WFSIPEKNRPLKGRINLVLSRELKEPPQGAHFLSRS LDDALKLTEQPELANKVDMVWIVGGSSVIKEFMN HPGHLKLFVTRIMQDFESDTFFPEIDLEKYKLLPEY PGVLSDVQEEKGIKYKFEVYEKND* | 1341 | 4660 |
| OT-CD19-010 (OT-CD19C-010)(CD8a leader; CD19 scFv; CD8a hinge + TM; 41BB; CD3zeta; linker; hDHFR(Amino acid 2-187 of WT)(Q36K, Y122I); stop) | MALPVTALLLPLALLLHAARPDIQMTQTTSSLSAS LGDRVTISCRASQDISKYLNWYQQKPDGTVKLLIY HTSRLHSGVPSRFSGSGSGTDYSLTISNLEQEDIAT YFCQQGNTLPYTFGGGTKLEITGGGGSGGGGSGG GGSEVKLQESGPGLVAPSQSLSVTCTVSGVSLPDY GVSWIRQPPRKGLEWLGVIWGSETTYYNSALKSR LTIIKDNSKSQVFLKMNSLQTDDTAIYYCAKHYY YGGSYAMDYWGQGTSVTVSSTTTPAPRPPTPAPTI ASQPLSLRPEACRPAAGGAVHTRGLDFACDIYIW | 1342 | 4661 |

TABLE 11-continued

Amino acid sequences of the CD19 CAR and its components

| Description | Amino Acid Sequence | Amino Acid SEQ ID NO | Nucleic Acid SEQ ID NO or Sequence |
|---|---|---|---|
| | APLAGTCGVLLLSLVITLYCKRGRKKLLYIFKQPF MRPVQTTQEEDGCSCRFPEEEEGGCELRVKFSRSA DAPAYKQGQNQLYNELNLGRREEYDVLDKRRGR DPEMGGKPRRKNPQEGLYNELQKDKMAEAYSEI GMKGERRRGKGHDGLYQGLSTATKDTYDALHM QALPPRGGSGGVGSLNCIVAVSQNMGIGKNGDLP WPPLRNEFRYFKRMTTTSSVEGKQNLVIMGKKT WFSIPEKNRPLKGRINLVLSRELKEPPQGAHFLSRS LDDALKLTEQPELANKVDMVWIVGGSSVIKEAM NHPGHLKLFVTRIMQDFESDTFFPEIDLEKYKLLPE YPGVLSDVQEEKGIKYKFEVYEKND* | | |
| OT-CD19-011 (OT-CD19C-011) (CD8a leader; CD19 scFv; CD8a hinge + TM; 41BB; CD3zeta; linker; hDHFR (Amino acid 2-187 of WT)(Q36F, N65F, Y122I); stop) | MALPVTALLLPLALLLHAARPDIQMTQTTSSLSAS LGDRVTISCRASQDISKYLNWYQQKPDGTVKLLIY HTSRLHSGVPSRFSGSGSGTDYSLTISNLEQEDIAT YFCQQGNTLPYTFGGGTKLEITGGGGSGGGGSGG GGSEVKLQESGPGLVAPSQSLSVTCTVSGVSLPDY GVSWIRQPPRKGLEWLGVIWGSETTYYNSALKSR LTIIKDNSKSQVFLKMNSLQTDDTAIYYCAKHYY YGGSYAMDYWGQGTSVTVSSTTTPAPRPPTPAPTI ASQPLSLRPEACRPAAGGAVHTRGLDFACDIYIW APLAGTCGVLLLSLVITLYCKRGRKKLLYIFKQPF MRPVQTTQEEDGCSCRFPEEEEGGCELRVKFSRSA DAPAYKQGQNQLYNELNLGRREEYDVLDKRRGR DPEMGGKPRRKNPQEGLYNELQKDKMAEAYSEI GMKGERRRGKGHDGLYQGLSTATKDTYDALHM QALPPRGGSGGVGSLNCIVAVSQNMGIGKNGDLP WPPLRNEFRYFFRMTTTSSVEGKQNLVIMGKKTW FSIPEKFRPLKGRINLVLSRELKEPPQGAHFLSRSL DDALKLTEQPELANKVDMVWIVGGSSVIKEAMN HPGHLKLFVTRIMQDFESDTFFPEIDLEKYKLLPEY PGVLSDVQEEKGIKYKFEVYEKND* | 1343 | 4662 |
| OT-CD19-014 (OT-CD19N-014) (CD8a leader; linker(SG); hDHFR(Amino acid 2-187 of WT)(Y122I, A125F); furin site (ESRRVRRNKRSK (SEQ ID NO: 2734)); CD19 scFV; CD8a hinge + TM; 41BB; CD3zeta; stop) | MALPVTALLLPLALLLHAARPSGVGSLNCIVAVSQ NMGIGKNGDLPWPPLRNEFRYFQRMTTTSSVEGK QNLVIMGKKTWFSIPEKNRPLKGRINLVLSRELKE PPQGAHFLSRSLDDALKLTEQPELANKVDMVWIV GGSSVIKEFMNHPGHLKLFVTRIMQDFESDTFFPEI DLEKYKLLPEYPGVLSDVQEEKGIKYKFEVYEKN DESRRVRRNKRSKDIQMTQTTSSLSASLGDRVTIS CRASQDISKYLNWYQQKPDGTVKLLIYHTSRLHS GVPSRFSGSGSGTDYSLTISNLEQEDIATYFCQQGN TLPYTFGGGTKLEITGGGGSGGGGSGGGGSEVKL QESGPGLVAPSQSLSVTCTVSGVSLPDYGVSWIRQ PPRKGLEWLGVIWGSETTYYNSALKSRLTIIKDNS KSQVFLKMNSLQTDDTAIYYCAKHYYYGGSYAM DYWGQGTSVTVSSTTTPAPRPPTPAPTIASQPLSLR PEACRPAAGGAVHTRGLDFACDIYIWAPLAGTCG VLLLSLVITLYCKRGRKKLLYIFKQPFMRPVQTTQ EEDGCSCRFPEEEEGGCELRVKFSRSADAPAYKQ GQNQLYNELNLGRREEYDVLDKRRGRDPEMGGK PRRKNPQEGLYNELQKDKMAEAYSEIGMKGERR RGKGHDGLYQGLSTATKDTYDALHMQALPPR* | 1344 | 4663; 4664 |
| OT-CD19-015 (OT-CD19N-015) (CD8a leader; linker(SG); hDHFR(Amino acid 2-187 of WT)(Q36K, Y122I); furin site (ESRRVRRNKRSK (SEQ ID NO: 2734)); CD19 scFV; CD8a hinge + TM; 41BB; CD3zeta; stop) | MALPVTALLLPLALLLHAARPSGVGSLNCIVAVSQ NMGIGKNGDLPWPPLRNEFRYFKRMTTTSSVEGK QNLVIMGKKTWFSIPEKNRPLKGRINLVLSRELKE PPQGAHFLSRSLDDALKLTEQPELANKVDMVWIV GGSSVIKEAMNHPGHLKLFVTRIMQDFESDTFFPEI DLEKYKLLPEYPGVLSDVQEEKGIKYKFEVYEKN DESRRVRRNKRSKDIQMTQTTSSLSASLGDRVTIS CRASQDISKYLNWYQQKPDGTVKLLIYHTSRLHS GVPSRFSGSGSGTDYSLTISNLEQEDIATYFCQQGN TLPYTFGGGTKLEITGGGGSGGGGSGGGGSEVKL QESGPGLVAPSQSLSVTCTVSGVSLPDYGVSWIRQ PPRKGLEWLGVIWGSETTYYNSALKSRLTIIKDNS KSQVFLKMNSLQTDDTAIYYCAKHYYYGGSYAM DYWGQGTSVTVSSTTTPAPRPPTPAPTIASQPLSLR PEACRPAAGGAVHTRGLDFACDIYIWAPLAGTCG VLLLSLVITLYCKRGRKKLLYIFKQPFMRPVQTTQ | 1345 | 4665; 4666 |

TABLE 11-continued

Amino acid sequences of the CD19 CAR and its components

| Description | Amino Acid Sequence | Amino Acid SEQ ID NO | Nucleic Acid SEQ ID NO or Sequence |
|---|---|---|---|
| | EEDGCSCRFPEEEEGGCELRVKFSRSADAPAYKQ GQNQLYNELNLGRREEYDVLDKRRGRDPEMGGK PRRKNPQEGLYNELQKDKMAEAYSEIGMKGERR RGKGHDGLYQGLSTATKDTYDALHMQALPPR* | | |

Constructs disclosed in Table 11, which are transcriptionally controlled by a CMV promoter, in some instances may be placed under the transcriptional control of a different promoter to test the role of promoters in CD19 CAR expression. In one embodiment, the CMV promoter may be replaced by an EF1a promoter. In another embodiment, the CMV promoter of the CD19 CAR, OT-CD19C-008 construct, may be replaced to generate OT-CD19C-024 construct, with a EF1a promoter. In another embodiment, the CMV promoter of the CD19 CAR, OT-CD19C-009 construct, may be replaced to generate OT-CD19C-025 construct, with a EF1a promoter.

In some embodiments, the extracellular targeting domain is joined through the hinge (also called space domain or spacer) and transmembrane regions to an intracellular signaling domain. The hinge connects the extracellular targeting domain to the transmembrane domain which transverses the cell membrane and connects to the intracellular signaling domain. The hinge may need to be varied to optimize the potency of CAR transformed cells toward cancer cells due to the size of the target protein where the targeting moiety binds, and the size and affinity of the targeting domain itself. Upon recognition and binding of the targeting moiety to the target cell, the intracellular signaling domain leads to an activation signal to the CAR T cell, which is further amplified by the "second signal" from one or more intracellular costimulatory domains. The CAR T cell, once activated, can destroy the target cell.

In some embodiments, the CAR of the present invention may be split into two parts, each part is linked a dimerizing domain, such that an input that triggers the dimerization promotes assembly of the intact functional receptor. Wu and Lim recently reported a split CAR in which the extracellular CD19 binding domain and the intracellular signaling element are separated and linked to the FKBP domain and the FRB* (T2089L mutant of FKBP-rapamycin binding) domain that heterodimerize in the presence of the rapamycin analog AP21967. The split receptor is assembled in the presence of AP21967 and together with the specific antigen binding, activates T cells (Wu et al., *Science*, 2015, 625 (6258): aab4077).

In some embodiments, the CAR of the present invention may be designed as an inducible CAR. Sakemura et al recently reported the incorporation of a Tet-On inducible system to the CD19 CAR construct. The CD19 CAR is activated only in the presence of doxycycline (Dox). Sakemura reported that Tet-CD19CAR T cells in the presence of Dox were equivalently cytotoxic against CD19$^+$ cell lines and had equivalent cytokine production and proliferation upon CD19 stimulation, compared with conventional CD19CAR T cells (Sakemura et al., Cancer Immuno. Res., 2016, Jun. 21, Epub ahead of print). In one example, this Tet-CAR may be the payload of the effector module under the control of SREs (e.g., DDs) of the invention. The dual systems provide more flexibility to turn-on and off of the CAR expression in transduced T cells.

According to the present invention, the payload of the present invention may be a first-generation CAR, or a second-generation CAR, or a third-generation CAR, or a fourth-generation CAR. Representative effector module embodiments comprising CAR constructs are illustrated in FIG. 13-FIG. 18. In some embodiments, the payload of the present invention may be a full CAR construct composed of the extracellular domain, the hinge and transmembrane domain and the intracellular signaling region. In other embodiments, the payload of the present invention may be a component of the full CAR construct including an extracellular targeting moiety, a hinge region, a transmembrane domain, an intracellular signaling domain, one or more co-stimulatory domain, and other additional elements that improve CAR architecture and functionality including but not limited to a leader sequence, a homing element and a safety switch, or the combination of such components.

CARs regulated by biocircuits and compositions of the present invention are tunable and thereby offer several advantages. The reversible on-off switch mechanism allows management of acute toxicity caused by excessive CAR-T cell expansion. Pulsatile CAR expression using SREs of the present invention may be achieved by cycling ligand level. The ligand conferred regulation of the CAR may be effective in offsetting tumor escape induced by antigen loss, avoiding functional exhaustion caused by tonic signaling due to chronic antigen exposure and improving the persistence of CAR expressing cells in vivo.

In some embodiments, biocircuits and compositions of the invention may be utilized to down regulate CAR expression to limit on target on tissue toxicity caused by tumor lysis syndrome. Down regulating the expression of the CARs of the present invention following anti-tumor efficacy may prevent (1) On target off tumor toxicity caused by antigen expression in normal tissue, (2) antigen independent activation in vivo.

In one embodiment, selection of a CAR with a lower affinity may provide more T cell signaling and less toxicity.

Extracellular Targeting Domain/Moiety

In accordance with the invention, the extracellular target moiety of a CAR may be any agent that recognizes and binds to a given target molecule, for example, a neoantigen on tumor cells, with high specificity and affinity. The target moiety may be an antibody and variants thereof that specifically binds to a target molecule on tumor cells, or a peptide aptamer selected from a random sequence pool based on its ability to bind to the target molecule on tumor cells, or a variant or fragment thereof that can bind to the target molecule on tumor cells, or an antigen recognition domain from native T-cell receptor (TCR) (e.g. CD4 extracellular domain to recognize HIV infected cells), or exotic recognition components such as a linked cytokine that leads to recognition of target cells bearing the cytokine receptor, or a natural ligand of a receptor.

In some embodiments, natural ligands may be used as the targeting moieties of the CARs of the present invention. Such natural ligands may be capable of binding to the antigens with affinity in the range of the scFvs and can redirect T cells specificity and effector functions to target cells expressing the complementary receptor. In some embodiments, the targeting moiety of the CAR may be neuregulin-1 (NRG1) which is a natural ligand for HER3 and HER4; VEGF which is a natural ligand of VEGFR; IL13 wildtype protein or IL13 mutein e.g. E13Y which binds to IL13Ra2; NKG2D ligand, which is a natural ligand of NKG2D receptor; CD70 which is ligand of CD27; and a proliferation-inducing ligand (APRIL) which is a natural high affinity ligand for BCMA8 and transmembrane activator and CAML interactor (TACI). Any of the ligand based BCMA CARs taught in the US Patent Publication No. US20160362467A1, the contents of which are incorporated by reference in their entirety.

In one embodiment, the targeting moiety of the CAR may recognize antigen such as, but not limited to a ganglioside, a growth factor receptor, a lectin or any other cell surface antigen. In some embodiments, any of the sequences described in Table 10 or Table 11 may be useful in the present invention.

In some embodiments, the targeting domain of a CAR may be a Ig NAR, a Fab fragment, a Fab' fragment, a F(ab)'2 fragment, a F(ab)'3 fragment, Fv, a single chain variable fragment (scFv), a bis-scFv, a (scFv)2, a minibody, a diabody, a triabody, a tetrabody, a disulfide stabilized Fv protein (dsFv), a unitbody, a nanobody, or an antigen binding region derived from an antibody that specifically recognizes a target molecule, for example a tumor specific antigen (TSA). In one embodiment, the targeting moiety is a scFv antibody. The scFv domain, when it is expressed on the surface of a CAR T cell and subsequently binds to a target protein on a cancer cell, is able to maintain the CAR T cell in proximity to the cancer cell and to trigger the activation of the T cell. A scFv can be generated using routine recombinant DNA technology techniques and is discussed in the present invention.

In one embodiment, the targeting moiety of the CAR may recognize CD19. CD19 is a well-known B cell surface molecule, which upon B cell receptor activation enhances B-cell antigen receptor induced signaling and expansion of B cell populations. CD19 is broadly expressed in both normal and neoplastic B cells. Malignancies derived from B cells such as chronic lymphocytic leukemia, acute lymphocytic leukemia and many non-Hodgkin lymphomas frequently retain CD19 expression. This near universal expression and specificity for a single cell lineage has made CD19 an attractive target for immunotherapies. Human CD19 has 14 exons wherein exon 1-4 encode the extracellular portion of the CD19, exon 5 encodes the transmembrane portion of CD19 and exons 6-14 encode the cytoplasmic tail. In one embodiment, the targeting moiety may comprise scFvs derived from the variable regions of the FMC63 antibody. FMC63 is an IgG2a mouse monoclonal antibody clone specific to the CD19 antigen that reacts with CD19 antigen on cells of the B lineage. The epitope of CD19 recognized by the FMC63 antibody is in exon 2 (Sotillo et al (2015) Cancer Discov; 5(12):1282-95; the contents of which are incorporated by reference in their entirety). In some embodiments, the targeting moiety of the CAR may be derived from the variable regions of other CD19 monoclonal antibody clones including but not limited to 4G7, SJ25C1, CVID3/429, CVID3/155, HIB19, and J3-119.

In some embodiments, the targeting moiety of a CAR may recognize a tumor specific antigen (TSA), for example a cancer neoantigen that is only expressed by tumor cells because of genetic mutations or alterations in transcription which alter protein coding sequences, therefore creating novel, foreign antigens. The genetic changes result from genetic substitution, insertion, deletion or any other genetic changes of a native cognate protein (i.e. a molecule that is expressed in normal cells). In the context of CD19, TSAs may include a transcript variant of human CD19 lacking exon 2 or lacking exon 5-6 or both (see International patent publication No. WO2016061368; the contents of which are incorporated herein by reference in their entirety). Since FMC63 binding epitope is in exon 2, CD19 lacking exon 2 is not recognized by FMC63 antibody. Thus, in some embodiments, the targeting moiety of the CAR may be an FMC63-distinct scFV. As used herein "FMC63-distinct" refers, to an antibody, scFv or a fragment thereof that is immunologically specific and binds to an epitope of the CD19 antigen that is different or unlike the epitope of CD19 antigen that is bound by FMC63. In some instances, targeting moiety may recognize a CD19 antigen lacking exon2. In one embodiment, the targeting moiety recognizes a fragment of CD19 encoded by exon 1, 3 and/or 4. In one example, the targeting moiety recognizes the epitope that bridges the portion of CD19 encoded by exon 1 and the portion of CD19 encoded by exon 3.

In some embodiments, the targeting moieties of the present invention may be scFv comprising the amino acid sequences in Table 12.

TABLE 12

| Target | Description | SEQ ID NO | Source |
|---|---|---|---|
| CD19 | scFv | 4667 | SEQ ID NO. 53 in EP3083671A1 |
| CD19 | scFv | 4668 | SEQ ID NO. 54 in EP3083671A1 |
| CD19 | scFv | 4669 | SEQ ID NO. 1 in WO2015157252 |
| CD19 | scFv | 4670 | SEQ ID NO. 10 in WO2015157252 |
| CD19 | scFv | 4671 | SEQ ID NO. 10 in WO2016033570 |
| CD19 | scFv | 4672 | SEQ ID NO. 11 in WO2015157252 |
| CD19 | scFv | 4673 | SEQ ID NO. 12 in WO2015157252 |
| CD19 | scFv | 4674 | SEQ ID NO. 2 in WO2015157252 |
| CD19 | scFv | 4675 | SEQ ID NO. 2 in WO2016033570 |
| CD19 | scFv | 4676 | SEQ ID NO. 206 in WO2016033570 |
| CD19 | scFv | 4677 | SEQ ID NO. 207 in WO2016033570 |
| CD19 | scFv | 4678 | SEQ ID NO. 208 in WO2016033570 |
| CD19 | scFv | 4679 | SEQ ID NO. 209 in WO2016033570 |
| CD19 | scFv | 4680 | SEQ ID NO. 210 in WO2016033570 |
| CD19 | scFv | 4681 | SEQ ID NO. 211 in WO2016033570 |
| CD19 | scFv | 4682 | SEQ ID NO. 213 in WO2016033570 |
| CD19 | scFv | 4683 | SEQ ID NO. 214 in WO2016033570 |
| CD19 | scFv | 4684 | SEQ ID NO. 215 in WO2016033570 |
| CD19 | scFv | 4685 | SEQ ID NO. 216 in WO2016033570 |
| CD19 | scFv | 4686 | SEQ ID NO. 217 in WO2016033570 |
| CD19 | scFv | 4687 | SEQ ID NO. 218 in WO2016033570 |
| CD19 | scFv | 4688 | SEQ ID NO. 219 in WO2016033570 |
| CD19 | scFv | 4689 | SEQ ID NO. 220 in WO2016033570 |
| CD19 | scFv | 4690 | SEQ ID NO. 221 in WO2016033570 |
| CD19 | scFv | 4691 | SEQ ID NO. 222 in WO2016033570 |
| CD19 | scFv | 4692 | SEQ ID NO. 223 in W02016033570 |
| CD19 | scFv | 4693 | SEQ ID NO. 224 in WO2016033570 |
| CD19 | scFv | 4694 | SEQ ID NO. 225 in WO2016033570 |
| CD19 | scFv | 4695 | SEQ ID NO. 3 in WO2015157252 |
| CD19 | scFv | 4696 | SEQ ID NO. 4 in WO2015157252 |
| CD19 | scFv | 4697 | SEQ ID NO. 4 in WO2016033570 |
| CD19 | scFv | 4698 | SEQ ID NO. 45 in WO2016033570 |
| CD19 | scFv | 4699 | SEQ ID NO. 47 in WO2016033570 |
| CD19 | scFv | 4700 | SEQ ID NO. 49 in WO2016033570 |

TABLE 12-continued scFv sequences

| Target | Description | SEQ ID NO | Source |
|---|---|---|---|
| CD19 | scFv | 4701 | SEQ ID NO. 5 in WO2015155341A1 |
| CD19 | scFv | 4702 | SEQ ID NO. 5 in WO2015157252 |
| CD19 | scFv | 4703 | SEQ ID NO. 51 in WO2016033570 |
| CD19 | scFv | 4704 | SEQ ID NO. 53 in WO2016033570 |
| CD19 | scFv | 4705 | SEQ ID NO. 55 in WO2016033570 |
| CD19 | scFv | 4706 | SEQ ID NO. 57 in WO2016033570 |
| CD19 | scFv | 4707 | SEQ ID NO. 59 in WO2015157252 |
| CD19 | scFv | 4708 | SEQ ID NO. 59 in WO2016033570 |
| CD19 | scFv | 4709 | SEQ ID NO. 6 in WO2015157252 |
| CD19 | scFv | 4710 | SEQ ID NO. 6 in WO2016033570 |
| CD19 | scFv | 4711 | SEQ ID NO. 7 in WO2014184143 |
| CD19 | scFv | 4712 | SEQ ID NO. 7 in WO2015157252 |
| CD19 | scFv | 4713 | SEQ ID NO. 8 in WO2015157252 |
| CD19 | scFv | 4714 | SEQ ID NO. 8 in WO2016033570 |
| CD19 | scFv | 4715 | SEQ ID NO. 87 in WO2016033570 |
| CD19 | scFv | 4716 | SEQ ID NO. 9 in WO2015157252 |
| CD19 | scFv | 4717 | SEQ ID NO. 9 in WO2016139487 |
| CD19 | scFv | 4718 | SEQ ID NO. 10 in US20160152723 |
| CD19 | scFv | 4719 | SEQ ID NO. 2 in US20160152723 |
| CD19 | scFv | 4720 | SEQ ID NO. 206 in US20160152723 |
| CD19 | scFv | 4721 | SEQ ID NO. 207 in US20160152723 |
| CD19 | scFv | 4722 | SEQ ID NO. 208 in US20160152723 |
| CD19 | scFv | 4723 | SEQ ID NO. 209 in US20160152723 |
| CD19 | scFv | 4724 | SEQ ID NO. 210 in US20160152723 |
| CD19 | scFv | 4725 | SEQ ID NO. 211 in US20160152723 |
| CD19 | scFv | 4726 | SEQ ID NO. 212 in US20160152723 |
| CD19 | scFv | 4727 | SEQ ID NO. 213 in US20160152723 |
| CD19 | scFv | 4728 | SEQ ID NO. 214 in US20160152723 |
| CD19 | scFv | 4729 | SEQ ID NO. 215 in US20160152723 |
| CD19 | scFv | 4730 | SEQ ID NO. 216 in US20160152723 |
| CD19 | scFv | 4731 | SEQ ID NO. 217 in US20160152723 |
| CD19 | scFv | 4732 | SEQ ID NO. 218 in US20160152723 |
| CD19 | scFv | 4733 | SEQ ID NO. 219 in US20160152723 |
| CD19 | scFv | 4734 | SEQ ID NO. 220 in US20160152723 |
| CD19 | scFv | 4735 | SEQ ID NO. 221 in US20160152723 |
| CD19 | scFv | 4736 | SEQ ID NO. 222 in US20160152723 |
| CD19 | scFv | 4737 | SEQ ID NO. 223 in US20160152723 |
| CD19 | scFv | 4738 | SEQ ID NO. 224 in US20160152723 |
| CD19 | scFv | 4739 | SEQ ID NO. 225 in US20160152723 |
| CD19 | scFv | 4740 | SEQ ID NO. 32 in EP3083691A2 |
| CD19 | scFv | 4741 | SEQ ID NO. 35 in EP3083691A2 |
| CD19 | scFv | 4742 | SEQ ID NO. 38 in EP3083691A2 |
| CD19 | scFv | 4743 | SEQ ID NO. 4 in US20160152723 |
| CD19 | scFv | 4744 | SEQ ID NO. 45 in US20160152723 |
| CD19 | scFv | 4745 | SEQ ID NO. 47 in US20160152723 |
| CD19 | scFv | 4746 | SEQ ID NO. 49 in US20160152723 |
| CD19 | scFv | 4747 | SEQ ID NO. 51 in US20160152723 |
| CD19 | scFv | 4748 | SEQ ID NO. 53 in US20160152723 |
| CD19 | scFv | 4749 | SEQ ID NO. 55 in US20160152723 |
| CD19 | scFv | 4750 | SEQ ID NO. 57 in US20160152723 |
| CD19 | scFv | 4751 | SEQ ID NO. 59 in US20160152723 |
| CD19 | scFv | 4752 | SEQ ID NO. 6 in US20160152723 |
| CD19 | scFv | 4753 | SEQ ID NO. 8 in US20160152723 |
| CD19 | scFv | 4754 | SEQ ID NO. 87 in US20160152723 |
| CD19 | scFv | 4755 | SEQ ID NO. 89 in US20160152723 |
| CD19 | scFv | 4756 | SEQ ID NO. 39 in WO2016109410 |
| CD19 | scFv | 4757 | SEQ ID NO. 37 in EP3083671A1 |
| CD19 | scFv | 4758 | SEQ ID NO. 174 in WO2016115482 |
| CD19 | scFv | 4759 | SEQ ID NO. 20 in WO2012079000 |
| CD19 | scFv | 4760 | SEQ ID NO. 32 in WO2015092024 |
| CD19 | scFv | 4761 | SEQ ID NO. 33 in WO2015092024A2 |
| CD19 | scFv | 4762 | SEQ ID NO. 35 in WO2015092024A2 |
| CD19 | scFv | 4763 | SEQ ID NO. 38 in WO2015092024A2 |
| CD19 | scFv | 4764 | SEQ ID NO. 40 in WO2016109410 |
| CD19 | scFv | 4765 | SEQ ID NO. 41 in WO2016109410 |
| CD19 | scFv | 4766 | SEQ ID NO. 42 in WO2016109410 |
| CD19 | scFv | 4767 | SEQ ID NO. 43 in WO2016109410 |
| CD19 | scFv | 4768 | SEQ ID NO. 44 in WO2016109410 |
| CD19 | scFv | 4769 | SEQ ID NO. 45 in WO2016109410 |
| CD19 | scFv | 4770 | SEQ ID NO. 46 in WO2016109410 |
| CD19 | scFv | 4771 | SEQ ID NO. 47 in WO2016109410 |
| CD19 | scFv | 4772 | SEQ ID NO. 48 in WO2016109410 |
| CD19 | scFv | 4773 | SEQ ID NO. 49 in WO2016109410 |
| CD19 | scFv | 4774 | SEQ ID NO. 5 in WO2015155341A1 |
| CD19 | scFv | 4775 | SEQ ID NO. 50 in WO2016109410 |
| CD19 | scFv | 4776 | SEQ ID NO. 51 in WO2016109410 |
| CD19 | scFv | 4777 | SEQ ID NO. 7 in US20160145337A1 |
| CD19 | scFv | 4778 | SEQ ID NO. 9 in US20160145337A1 |
| CD19 | scFv | 4779 | SEQ ID NO. 20 in U.S. Pat. No. 9,499,629B2 |
| CD19 | scFv | 4780 | SEQ ID NO. 6 in WO2015155341A1 |
| CD19 | scFv | 4781 | SEQ ID NO. 73 in WO2016164580 |
| CD19 | scFv | 4782 | SEQ ID NO. 10 US20160152723 |
| CD19 | scFv | 4783 | SEQ ID NO. 2 in US20160152723 |
| CD19 | scFv | 4784 | SEQ ID NO. 206 in US20160152723 |
| CD19 | scFv | 4785 | SEQ ID NO. 207 in US20160152723 |
| CD19 | scFv | 4786 | SEQ ID NO. 209 in US20160152723 |
| CD19 | scFv | 4787 | SEQ ID NO. 210 in US20160152723 |
| CD19 | scFv | 4788 | SEQ ID NO. 212 in US20160152723 |
| CD19 | scFv | 4789 | SEQ ID NO. 216 in US20160152723 |
| CD19 | scFv | 4790 | SEQ ID NO. 218 in US20160152723 |
| CD19 | scFv | 4791 | SEQ ID NO. 219 in US20160152723 |
| CD19 | scFv | 4792 | SEQ ID NO. 220 in US20160152723 |
| CD19 | scFv | 4793 | SEQ ID NO. 221 in US20160152723 |
| CD19 | scFv | 4794 | SEQ ID NO. 222 in US20160152723 |
| CD19 | scFv | 4795 | SEQ ID NO. 223 in US20160152723 |
| CD19 | scFv | 4796 | SEQ ID NO. 224 in US20160152723 |
| CD19 | scFv | 4797 | SEQ ID NO. 225 in US20160152723 |
| CD19 | scFv | 4798 | SEQ ID NO. 4 in US20160152723 |
| CD19 | scFv | 4799 | SEQ ID NO. 45 in US20160152723 |
| CD19 | scFv | 4800 | SEQ ID NO. 47 in US20160152723 |
| CD19 | scFv | 4801 | SEQ ID NO. 49 in US20160152723 |
| CD19 | scFv | 4802 | SEQ ID NO. 51 in US20160152723 |
| CD19 | scFv | 4803 | SEQ ID NO. 53 in US20160152723 |
| CD19 | scFv | 4804 | SEQ ID NO. 55 in US20160152723 |
| CD19 | scFv | 4805 | SEQ ID NO. 57 in US20160152723 |
| CD19 | scFv | 4806 | SEQ ID NO. 59 in US20160152723 |
| CD19 | scFv | 4807 | SEQ ID NO. 6 in US20160152723 |
| CD19 | scFv | 4808 | SEQ ID NO. 8 in US20160152723 |
| CD19 | scFv | 4809 | SEQ ID NO. 87 in US20160152723 |
| CD19 | scFv | 4810 | SEQ ID NO. 89 in US20160152723 |
| CD19 | scFv | 4811 | SEQ ID NO. 5 in WO2016055551 |

In some embodiments, the targeting moieties of the present invention may be scFv comprising the amino acid sequences in Table 13.

TABLE 13 scFv sequences

| Target | Description and Clone name | Source | SEQ ID NO. |
|---|---|---|---|
| ALK | ALK15 scFv | SEQ ID NO. 17 in WO2015069922 | 4812 |
| ALK | ALK48 scFv | SEQ ID NO. 18 in WO2015069922 | 4813 |
| ALK | ALK53 scFv | SEQ ID NO. 19 in WO2015069922 | 4814 |
| ALK | ALK58 scFv | SEQ ID NO. 20 in WO2015069922 | 4815 |
| ALK | humanized ALK15 scFv | SEQ ID NO. 21 in WO2015069922 | 4816 |
| ALK | humanized ALK48 scFv | SEQ ID NO. 22 in WO2015069922 | 4817 |
| ALK | humanized ALK53 scFv | SEQ ID NO. 23 in WO2015069922 | 4818 |

TABLE 13-continued scFv sequences

| Target | Description and Clone name | Source | SEQ ID NO. |
|---|---|---|---|
| ALK | humanized ALK58 scFv | SEQ ID NO. 24 in WO2015069922 | 4819 |
| CD22 | CD22 (m971) scFv | SEQ ID NO. 9 in WO2014065961 | 4820 |
| CD22 | CD22 (HA22 or BL22) scFv | SEQ ID NO. 5 in WO2013059593 | 4821 |
| CD22 | CD22 (HA22 or BL22) scFv | SEQ ID NO. 6 in WO2013059593 | 4822 |
| CD276 | CD276 scFv | SEQ ID NO. 21 in WO2017044699 | 4823 |
| CD276 | CD276 scFv (CD276.6) | SEQ ID NO. 10 in WO2014160627 | 4824 |
| CD276 | CD276 scFv (CD276.1) | SEQ ID NO. 19 in WO2014160627 | 4825 |
| CD276 | CD276 scFv (CD276.17) | SEQ ID NO. 28 in WO2014160627 | 4826 |
| GD2 | hu3F8/huOKT3 scFv | SEQ ID No. 23 in WO2011160119 | 4827 |
| GD2 | hu3F8/C8.2.5 scFv | SEQ ID No. 24 in WO2011160119 | 4828 |
| Gangliosides including GD2 | DMab14-86184 scFv | SEQ ID No. 6 in WO2012071216 | 4829 |
| Gangliosides including GD2 | GMab1 scFv | SEQ ID No. 20 in WO2012071216 | 4830 |
| Gangliosides including GD2 | GMab2 scFV | SEQ ID No. 21 in WO2012071216 | 4831 |
| Gangliosides including GD2 | DMab14 scFV | SEQ ID No. 22 in WO2012071216 | 4832 |
| GD2 | GD2 scFv | SEQ ID NO. 19 in WO2016134286 | 4833 |
| GD2 | GD2 scFv | SEQ ID NO. 20 in WO2016134287 | 4834 |
| GD2 | GD2 scFv | SEQ ID NO. 21 in WO2016134288 | 4835 |
| GD2 | Murine KM666 sequence | SEQ ID NO. 7 in WO2015132604 | 4836 |
| GD2 | Humanized KM666 sequence | SEQ ID NO. 8 in WO2015132604 | 4837 |
| GD2 | GD2 scFv | SEQ ID NO. 11 in US20160032009 | 4838 |
| GD2 | GD2 scFv | SEQ ID NO. 12 in US20160032009 | 4839 |
| GD2 | GD2 scFv | SEQ ID NO. 13 in US20160032009 | 4840 |
| GD2 | GD2 scFv | SEQ ID NO. 14 in US20160032009 | 4841 |
| GD2 | GD2 scFv | SEQ ID NO. 15 in US20160032009 | 4842 |
| GD2 | GD2 scFv | SEQ ID NO. 16 in US20160032009 | 4843 |
| GD2 | GD2 scFv | SEQ ID NO. 17 in US20160032009 | 4844 |
| GD2 | GD2 scFv | SEQ ID NO. 18 in US20160032009 | 4845 |
| GD2 | GD2 scFv | SEQ ID NO. 19 in US20160032009 | 4846 |
| GD2 | GD2 scFv | SEQ ID NO. 20 in US20160032009 | 4847 |
| GD2 | GD2 scFv | SEQ ID NO. 21 in US20160032009 | 4848 |
| GD2 | GD2 scFv | SEQ ID NO. 22 in US20160032009 | 4849 |
| GD2 | GD2 scFv | SEQ ID NO. 23 in US20160032009 | 4850 |
| GD2 | GD2 scFv | SEQ ID NO. 24 in US20160032009 | 4851 |
| GD2 | GD2 scFv | SEQ ID NO. 25 in US20160032009 | 4852 |
| GD2 | Murine KM666 scFv sequence | SEQ ID NO. 7 in US20170066838 | 4853 |
| GD2 | Humanized KM666 scFv sequence | SEQ ID NO. 8 in US20170066838 | 4854 |
| GD2 | GD2 (clone 1A7) scFv | SEQ ID NO. 1 in US 20050287148A1 | 4855 |
| Her2 | F5 | SEQ ID NO. 1 in U.S. Pat. No. 9,388,244 | 4856 |
| Her2 | C1 | SEQ ID NO. 2 in U.S. Pat. No. 9,388,244 | 4857 |
| anti-Her2/neu-anti-CD3 | anti-Her2/neu - anti-CD3 bispecific antibody scFv | SEQ ID NO. 1 in WO2014079000A1 | 4858 |
| Her2 | F5 | SEQ ID NO. 1 in U.S. Pat. No. 7,332,580 | 4859 |
| Her2 | HER3.B12 | SEQ ID NO. 6 in U.S. Pat. No. 7,332,580 | 4860 |
| Her2 | FL/Fc/HER2Fv - Flt3 ligand extracellular region (hFLex); IgG1 Fc; rhuMAb ScFv | SEQ ID NO. 62 in US20040254108 | 4861 |
| Her2 | Periplasmic 6 × -His (SEQ ID NO. 3091) C terminal scFv-4D5 | SEQ ID NO. 26 in U.S. Pat. No. 7,632,924 | 4862 |
| Her2 | Periplasmic 6 × -His (SEQ ID NO. 3091) N terminal scFv-4D5 | SEQ ID NO. 28 in U.S. Pat. No. 7,632,924 | 4863 |

Intracellular Signaling Domains

The intracellular domain of a CAR fusion polypeptide, after binding to its target molecule, transmits a signal to the immune effector cell, activating at least one of the normal effector functions of immune effector cells, including cytolytic activity (e.g., cytokine secretion) or helper activity. Therefore, the intracellular domain comprises an "intracellular signaling domain" of a T cell receptor (TCR).

In some aspects, the entire intracellular signaling domain can be employed. In other aspects, a truncated portion of the intracellular signaling domain may be used in place of the intact chain as long as it transduces the effector function signal.

In some aspects, the entire intracellular signaling domain can be employed. In other aspects, a truncated portion of the intracellular signaling domain may be used in place of the intact chain if it transduces the effector function signal.

In some embodiments, the intracellular signaling domain of the present invention may contain signaling motifs which are known as immunoreceptor tyrosine-based activation motifs (ITAMs). Examples of ITAM containing cytoplasmic signaling sequences include those derived from TCR CD3zeta, FcR gamma, FcR beta, CD3 gamma, CD3 delta, CD3 epsilon, CD5, CD22, CD79a, CD79b, and CD66d. In one example, the intracellular signaling domain is a CD3 zeta (CD3ζ) signaling domain.

In some embodiments, the intracellular region of the present invention further comprises one or more costimulatory signaling domains which provide additional signals to the immune effector cells. These costimulatory signaling domains, in combination with the signaling domain can further improve expansion, activation, memory, persistence, and tumor-eradicating efficiency of CAR engineered immune cells (e.g., CAR T cells). In some cases, the costimulatory signaling region contains 1, 2, 3, or 4 cytoplasmic domains of one or more intracellular signaling and/or costimulatory molecules. The costimulatory signaling domain may be the intracellular/cytoplasmic domain of a costimulatory molecule, including but not limited to CD2, CD7, CD27, CD28, 4-1BB (CD137), OX40 (CD134), CD30, CD40, ICOS (CD278), GITR (glucocorticoid-induced tumor necrosis factor receptor), LFA-1 (lymphocyte function-associated antigen-1), LIGHT, NKG2C, B7-H3. In one example, the costimulatory signaling domain is derived from the cytoplasmic domain of CD28. In another example, the costimulatory signaling domain is derived from the cytoplasmic domain of 4-1BB (CD137). In another example, the co-stimulatory signaling domain may be an intracellular domain of GITR as taught in U.S. Pat. No. 9,175,308; the contents of which are incorporated herein by reference in its entirety.

In some embodiments, the intracellular region of the present invention may comprise a functional signaling domain from a protein selected from the group consisting of an MHC class I molecule, a TNF receptor protein, an immunoglobulin-like protein, a cytokine receptor, an integrin, a signaling lymphocytic activation protein (SLAM) such as CD48, CD229, 2B4, CD84, NTB-A, CRACC, BLAME, CD2F-10, SLAMF6, SLAMF7, an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), SLAMF7, NKp80 (KLRF1), NKp44, NKp30, NKp46, CD19, CD4, CD8alpha, CD8beta, IL2R beta, IL2R gamma, IL7R alpha, IL15Ra, ITGA4, VLA1, CD49a, ITGA4, IA4, CD49D, ITGA6, VLA-6, CD49f, ITGAD, CD1 d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, NKD2C SLP76, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, CD270 (HVEM), GADS, SLP-76, PAG/Cbp, CD19a, a ligand that specifically binds with CD83, DAP 10, TRIM, ZAP70, Killer immunoglobulin receptors (KIRs) such as KIR2DL1, KIR2DL2/L3, KIR2DL4, KIR2DL5A, KIR2DL5B, KIR2DS1, KIR2DS2, KIR2DS3, KIR2DS4, KIR2DS5, KIR3DL1/S1, KIR3DL2, KIR3DL3, and KIR2DP1; lectin related NK cell receptors such as Ly49, Ly49A, and Ly49C.

In some embodiments, the intracellular signaling domain of the present invention may contain signaling domains derived from JAK-STAT. In other embodiments, the intracellular signaling domain of the present invention may contain signaling domains derived from DAP-12 (Death associated protein 12) (Topfer et al., Immunol., 2015, 194: 3201-3212; and Wang et al., Cancer Immunol., 2015, 3: 815-826). DAP-12 is a key signal transduction receptor in NK cells. The activating signals mediated by DAP-12 play important roles in triggering NK cell cytotoxicity responses toward certain tumor cells and virally infected cells. The cytoplasmic domain of DAP12 contains an Immunoreceptor Tyrosine-based Activation Motif (ITAM). Accordingly, a CAR containing a DAP12-derived signaling domain may be used for adoptive transfer of NK cells.

In some embodiments, T cells engineered with two or more CARs incorporating distinct co-stimulatory domains and regulated by distinct DD may be used to provide kinetic control of downstream signaling.

In some embodiments, the intracellular domain of the present invention may comprise amino acid sequences of Table 14.

TABLE 14

Intracellular signaling and co-stimulatory domains

| Description | Amino Acid Sequence | Amino Acid SEQ ID |
|---|---|---|
| 2B4 co-stimulatory domain | WRRKRKEKQSETSPKEFLTIYEDVKDLKTRRNHEQEQTFP GGGSTIYSMIQSQSSAPTSQEPAYTLYSLIQPSRKSGSRKRN HSPSFNSTIYEVIGKSQPKAQNPARLSRKELENFDVYS | 421 |
| CD27 co-stimulatory domain | HQRRKYRSNKGESPVEPAEPCRYSCPREEEGSTIPIQEDYR KPEPACSP | 422 |
| CD272(BTLA1) co-stimulatory domain | RRHQGKQNELSDTAGREINLVDAHLKSEQTEASTRQNSQ VLLSETGIYDNDPDLCFRMQEGSEVYSNPCLEENKPGVYA SLNHSVIGPNSRLARNVKEAPTEYASICVRS | 2739 |
| CD272(BTLA1) co-stimulatory domain | CCLRRHQGKQNELSDTAGREINLVDAHLKSEQTEASTRQ NSQVLLSETGIYDNDPDLCFRMQEGSEVYSNPCLEENKPG IVYASLNHSVIGPNSRLARNVKEAPTEYASICVRS | 424 |
| CD28 co-stimulatory | FWVLVVVGGVLACYSLLVTVAFIIFWV | 425 |
| CD28 co-stimulatory domain | KRGRKKLLYIFKQPFMRPVQTTQEEDGCSCRFPEEEEGGC EL | 426 |
| CD28 co-stimulatory domain | FWVRSKRSRLLHSDYMNMTPRRPGPTRKHYQPYAPPRDF AAYRS | 427 |
| CD28 co-stimulatory domain | RSKRSRGGHSDYMNMTPRRPGPTRKHYQPYAPPRDFAAY YRS | 428 |

TABLE 14-continued

Intracellular signaling and co-stimulatory domains

| Description | Amino Acid Sequence | Amino Acid SEQ ID |
|---|---|---|
| CD28 co-stimulatory domain | RSKRSRGGHSDYIVNMTPRRPGPTRKHYQPYAPPRDFAAYRS | 429 |
| CD28 co-stimulatory signaling region | MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS | 430 |
| CD30 co-stimulatory domain | RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK | 431 |
| CD30 co-stimulatory domain | RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK | 432 |
| GITR co-stimulatory domain | HIWQLRSQCMWPRETQLLLEVPPSTEDARSCQFPEEERGERSAEEKGRLGDLWV | 433 |
| HVEM co-stimulatory domain | CVKRRKPRGDVVKVIVSVQRKRQEAEGEATVIEALQAPPDVTTVAVEETIPSFTGRSPNH | 434 |
| ICOS co-stimulatory domain | TKKKYSSSVHDPNGEYMFMRAVNTAKKSRLTDVTL | 435 |
| ICOS co-stimulatory signaling domain | CWLTKKKYSSSVHDPNGEYMFMRAVNTAKKSRLTDVTL | 436 |
| LAG-3 co-stimulatory region | HLWRRQWRPRRFSALEQGIHPPQAQSKIEELEQEPEPEPEPEPEPEPEPEPEQL | 437 |
| OX40 co-stimulatory domain | ALYLLRRDQRLPPDAHKPPGGGSFRTPIQEEQADAHSTLAKI | 438 |
| OX40 co-stimulatory domain | RRDQRLPPDAHKPPGGGSFRTPIQEEQADAHSTLAKI | 439 |
| 4-1BB intracellular domain | KRGRKKLLYIFKQPFMRPVQTIQEEDGCSCRFPEEEEGGCEL | 440 |
| 4-1BB signaling domain | KRGRKKLLYIFKQPFMRPVQTTQEEDGCSCRFPEEEEGGYEL | 441 |
| 4-1BB-CD3Zeta intracellular domain | TGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 442 |
| 4-1BB-Z endodomain fusion | KRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 443 |
| CD127 intracellular domain | KRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ | 444 |
| CD137 intracellular domain | RFSVVKRGRKKLLYIFKQPFMRPVQTTQEEDGCSCRFPEEEEGGCEL | 445 |
| CD148 intracellular domain | RKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYW | 446 |

TABLE 14-continued

Intracellular signaling and co-stimulatory domains

| Description | Amino Acid Sequence | Amino Acid SEQ ID |
|---|---|---|
| | PSKQAQDYGDITVAMTSEIVLPEWTIRDFTVKNIQTSESHP LRQFHFTSWPDHGVPDTTDLLINFRYLVRDYMKQSPPESPI LVHCSAGVGRTGTFIAIDRLIYQIENENTVDVYGIVYDLR MHRPLMVQTEDQYVFLNQCVLDIVRSQKDSKVDLIYQNT TAMTIYENLAPVTTFGKTNGYIA | |
| CD27 intracellular domain | QRRKYRSNKGESPVEPAEPCHYSCPREEEGSTIPIQEDYRK PEPACSP | 447 |
| CD28 intracellular domain | FAAYRS | 448 |
| CD28 signaling chain | FWVLVVVGGVLACYSLLVTVAFIIFWVRSKRSRLLHSDY MNMTPRRPGPTRKHYQPYAPPRDFAAYRS | 449 |
| CD28 signaling domain | RSKRSRLLHSDYMNMTPRRPGPTRKHYQPYAPPRDFAAY RS | 450 |
| CD28 signaling domain | SKRSRLLHSDYMNMTPRRPGPTRKHYQPYAPPRDFAAYR S | 451 |
| CD28 singaling domain | IEVMYPPPYLDNEKSNGTIIHVKGKHLCPSPLFPGPSKPFW VLVVVGGVLACYSLLVTVAFIIFWRSKRSRLLHSDYMNM TPRRPGPTRKHYQPYAPPRDFAAYRS | 452 |
| CD28, 4-1BB, and/or CD3ζ signaling domain | RSKRSRLLHSDYMNMTPRRPGPTRKHYQPYAPPRDFAAY RSRFSVVKRGRKKLLYIFKQPFMRPVQTTQEEDGCSCRFP EEEEGGCELRVKFSRSADAPAYQQGQNQLYNELNLGRRE EYDVLDKRRGRDPEMGGKPRRKNPQEGLYNELQKDKMA EAYSEIGMKGERRRGKGHDGLYQGLSTATKDTYDALHM QALPPR | 453 |
| CD28/CD3ζ | AAAIEVMYPPPYLDNEKSNGTIIHVKGKHLCPSPLFPGPSK PFWVLVVVGGVLACYSLLVTVAFIIFWVRSKRSRLLHSDY MNMTPRRPGPTRKHYQPYAPPRDFAAYRSRVKFSRSADA PAYQQGQNQLYNELNLGRREEYDVLDKRRGRDPEMGGK PRRKNPQEGLYNELQKDKMAEAYSEIGMKGERRRGKGH DGLYQGLSTATKDTYDALHMQALPPR | 454 |
| CD28-OXZ intracellular domain | RSKRSRLLHSDYNMTPRRPGPTRKHYQPYAPPRDFAAYRS RDQRLPPDAHKPPGGGSFRTPIQEEQADAHSTLAKIRVKFS RSADAPAYQQGQNQLYNELNLGRREEYDVLDKRRGRDP EMGGKPRRKNPQEGLYNELQKDKMAEAYSEIGMKGERR RGKGHDGLYQGLSTATKDTYDALHMQALPPR | 455 |
| CD28-4-1BB intracellular domain | MFWVLVVVGGVLACYSLLVTVAFIIFWVKRGRKKLLYIF KQPFMRPVQTTQEEDGCSCRFPEEEEGGCEL | 456 |
| CD28-4-1BB intracellular domain | IEVMYPPPYLDNEKSNGTIIHVKGKHLCPSPLFPGPSKPFW VLVVVGGVLACYSLLVTVAFIIFWVKRGRKKLLYIFKQPF MRPVQTTQEEDGCSCRFPEEEEGGCEL | 457 |
| CD28-CD3 Zeta intracellular domain | RSKRSRLLHSDYMNMTPRRPGPTRKHYQPYAPPRDFAAY RSRVKFSRSADAPAYQQGQNQLYNELNLGRREEYDVLDK RRGRDPEMGGKPRRKNPQEGLYNELQKDKMAEAYSEIG MKGERRRGKGHDGLYQGLSTATKDTYDALHMQALPPR | 458 |
| CD28-CD3Zeta intracellular domain | KRSRLLHSDYMNMTPRRPGPTRKHYQPYAPPRDFAAYRS RVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 459 |
| CD3 delta chain intracellular signaling domain | MEHSTFLSGLVLATLLSQVSPFKIPIEELEDRVFVNCNTSIT WVEGTVGTLLSDITRLDLGKRILDPRGIYRCNGTDIYKDK ESTVQVHYRMCQSCVELDPATVAGIIVTDVIATLLLALGV FCFAGHETGRLSGAADTQALLRNDQVYQPLRDRDDAQYS HLGGNWARNK | 460 |
| CD3 delta chain intracellular signaling domain | MEHSTFLSGLVLATLLSQVSPFKIPIEELEDRVFVNCNTSIT WVEGTVGTLLSDITRLDLGKRILDPRGIYRCNGTDIYKDK ESTVQVHYRTADTQALLRNDQVYQPLRDRDDAQYSHLG GNWARNK | 461 |

TABLE 14-continued

Intracellular signaling and co-stimulatory domains

| Description | Amino Acid Sequence | Amino Acid SEQ ID |
|---|---|---|
| CD3 delta chain intracellular signaling domain | DQVYQPLRDRDDAQYSHLGGN | 462 |
| CD3 delta intracellular domain | MEHSTFLSGLVLATLLSQVSPFKIPIEELEDRVFVNCNTSIT WVEGTVGTLLSDITRLDLGKRILDPRGIYRCNGTDIYKDK ESTVQVHYRMCQSCVELDPATVAGIIVTDVIATLLLALGV FCFAGHETGRLSGAADTQALLRNDQVYQPLRDRDDAQYS HLGGNWARNK | 463 |
| CD3 delta intracellular domain | MEHSTFLSGLVLATLLSQVSPFKIPIEELEDRVFVNCNTSIT WVEGTVGTLLSDITRLDLGKRILDPRGIYRCNGTDIYKDK ESTVQVHYRTADTQALLRNDQVYQPLRDRDDAQYSHLG GNWARNK | 464 |
| CD3 delta intrcellular domain | DQVYQPLRDRDDAQYSHLGGN | 465 |
| CD3 epsilon intracellular domain | MQSGTHWRVLGLCLLSVGVWGQDGNEEMGGITQTPYKV SISGTTVILTCPQYPGSEILWQHNDKNIGGDEDDKNIGSDE DHLSLKEFSELEQSGYYVCYPRGSKPEDANFYLYLRARVC ENCMEMDVMSVATIVIVDICITGGLLLLVYYWSKNRKAK AKPVTRGAGAGGRQRGQNKERPPPVPNPDYEPIRKGQRD LYSGLNQRRI | 466 |
| CD3 epsilon intracellular domain | NPDYEPIRKGQRDLYSGLNQR | 467 |
| CD3 gamma intracellular domain | MEQGKGLAVLILAIILLQGTLAQSIKGNHLVKVYDYQEDG SVLLTCDAEAKNITWFKDGKMIGFLTEDKKKWNLGSNAK DPRGMYQCKGSQNKSKPLQVYYRMCQNCIELNAATISGF LFAEIVSIFVLAVGVYFIAGQDGVRQSRASDKQTLLPNDQ LYQPLKDREDDQYSHLQGNQLRRN, | 468 |
| CD3 gamma intracellular domain | DQLYQPLKDREDDQYSHLQGN | 469 |
| CD3 gamma intracellular domain | DQLYQPLKDREDDQYSHLQGN | 470 |
| CD3 gamma intracellular domain | MEQGKGLAVLILAIILLQGTLAQSIKGNHLVKVYDYQEDG SVLLTCDAEAKNITWFKDGKMIGFLTEDKKKWNLGSNAK DPRGMYQCKGSQNKSKPLQVYYRMCQNCIELNAATISGF LFAEIVSIFVLAVGVYFIAGQDGVRQSRASDKQTLLPNDQ LYQPLKDREDDQYSHLQGNQLRRN | 471 |
| CD3 zeta intracellular domain | MKWKALFTAAILQAQLPITEAQSFGLLDPKLCYLLDGILFI YGVILTALFLRVKFSRSADAPAYQQGQNQLYNELNLGRR EEYDVLDKRRGRDPEMGGKPRRKNPQEGLYNELQKDKM AEAYSEIGMKGERRRGKGHDGLYQGLSTATKDTYDALH MQALPPR | 472 |
| CD3 zeta intracellular domain | MKWKALFTAAILQAQLPITEAQSFGLLDPKLCYLLDGILFI YGVILTALFLRVKFSRSADAPAYQQGQNQLYNELNLGRR EEYDVLDKRRGRDPEMGGKPQRRKNPQEGLYNELQKDK MAEAYSEIGMKGERRRGKGHDGLYQGLSTATKDTYDAL HMQALPPR | 473 |
| CD3 zeta intracellular domain | MKWKALFTAAILQAQLPITEAQSFGLLDPKLCYLLDGILFI YGVILTALFLRVKFSRSADAPAYQQGQNQLYNELNLGRR EEYDVLDKRRGRDPEMGGKPQRRKNPQEGLYNELQKDK MAEAYSEIGMKGERRRGKGHDGLYQGLSTATKDTYDAL HMQALPPR | 474 |
| CD3 zeta intracellular domain | NQLYNELNLGRREEYDVLDKR | 475 |
| CD3 zeta domain 2 (NM_000734.3) | RVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 476 |
| CD3 zeta intracellular domain | DGLYQGLSTATKDTYDALHMQ | 477 |

TABLE 14-continued

Intracellular signaling and co-stimulatory domains

| Description | Amino Acid Sequence | Amino Acid SEQ ID |
|---|---|---|
| CD3 zeta intracellular domain | RVKFSRSAEPPAYQQGQNQLYNELNLGRREEYDVLDKRR GRDPEMGGKPRRKNPQEGLYNELQKDKMAEAYSEIGMK GERRRGKGHDGLYQGLSTATKDTYDALHMQALPPR | 478 |
| CD3 zeta intracellular domain | RVKFSRSADAPAYQQGQNQLYNELNLGRREEYDVLDKR RGRDPEMGGKPQRRKNPQEGLYNELQKDKMAEAYSEIG MKGERRRGKGHDGLYQGLSTATKDTYDALHMQALPPR | 479 |
| CD3 zeta intracellular domain | RSRVKFSRSADAPAYQQGQNQLYNELNLGRREEYDVLDK RRGRDPEMGGKPRRKNPQEGLYNELQKDKMAEAYSEIG MKGERRRGKGHDGLYQGLSTATKDTYDALHMQALPPR | 480 |
| CD3 zeta intracellular domain | RVKFSRSADAPAYQQGEYDVLDKRRGRDPEMGGKPRRK NPQEGLYNELQKDKMAEAYSEIGMKGERRRGKGHDGLY QGLSTATKDTYDALHMQALPPR | 481 |
| CD3 zeta intracellular domain | RVKFSRSADAPAYQQGQNQLYNELNLGRREEVDVLDKR RGRDPEMGGKPRRKNPQEGLYNELQKDKMAEAYSEIGM KGERRRGKGHDGLYQGLSTATKDTYDALHMQALPPR | 482 |
| CD3 zeta intracellular domain | MIPAVVLLLLLLVEQAAALGEPQLCYILDAILFLVGIVLTL LVCRLKIQVRKAAITSYEKSRVKFSRSADAPAYQQGQNQL YNELNLGRREEYDVLDKRRGRDPEMGGKPRRKNPQEGL YNELQKDKMAEAVSEIGMKGERRRGKGHDGLYQGLSTA TKDTYDALHMQALPPR | 483 |
| CD3 zeta intracellular domain | LRVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 484 |
| CD3 zeta intracellular domain | RVKFSRSADAPAYQQGQNQLYNELNLGRREEYDVLDKR RGRDPEMGGKPQRRKNPQEGLY | 485 |
| CD3 zeta intracellular domain | LRVKFSRSADAPAYQQGQNQLYNELNLGRREEYDVLDKR RGRDPEMGGKPQRRKNPQEGLYNELQKDKMAEAYSEIG MKGERRRGKGHDGLYQGLSTATKDTYDALHMQALPPR | 486 |
| CD3 zeta intracellular domain | RRVKFSRSADAPAYQQGQNQLYNELNLGRREEYDVLDK RRGRDPEMGGKPRRKNPQEGLYNELQKDKMAEAYSEIG MKGERRRGKGHDGLYQGLSTATKDTYDALHMQALPPR | 487 |
| CD3 zeta intracellular domain | NQLYNELNLGRREEYDVLDKR | 488 |
| CD3 zeta intracellular domain | EGLYNELQKDKMAEAYSEIGMK | 489 |
| CD3 zeta intracellular domain | DGLYQGLSTATKDTYDALHMQ | 490 |
| CD3 zeta intracellular domain | RVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 491 |
| CD3 zeta intracellular domain | RVKFSRSADAPAYKQGQNQLYNELNLGRREEYDVLDKR RGRDPEMGGKPRRKNPQEGLYNELQKDKMAEAYSEIGM KGERRRGKGHDGLYQGLSTATKDTYDALHMQALPPR | 492 |
| CD3 zeta intracellular domain | RVKFSRSADAPAYQQGQNQLYNELNLGRREEYDVLDKR RGRDPEMGGKPRRKNPQEGLYNELQKDKMAEAYSEIGM KGERRRGKGHDGLYQGLSTATKDTYDALHMQALP | 493 |
| CD3 zeta intracellular domain | DPKLCYLLDGILFIYGVILTALFLRVKFSRSADAPAYQQGQ NQLYNELNLGRREEYDVLDKRRGRDPEMGGKPQRRKNP QEGLYNELQKDKMAEAYSEIGMKGERRRGKGHDGLYQG LSTATKDTYDALHMQALPPR | 494 |
| CD3 zeta intracellular domain | MKWKALFTAAILQAQLPITEAQSFGLLDPKLCYLLDGILFI YGVILTALFLRVKFSRSADAPAYQQGQNQLYNELNLGRR EEYDVLDKRRGRDPEMGGKPRRKNPQEGLYNELQKDKM AEAYSEIGMKGERRRGKGHDGLYQGLSTATKDTYDALH MQALPPR | 495 |

TABLE 14-continued

Intracellular signaling and co-stimulatory domains

| Description | Amino Acid Sequence | Amino Acid SEQ ID |
|---|---|---|
| CD40 intracellular domain | RSRDQRLPPDAHKPPGGGSFRTPIQEEQADAHSTLAKI | 496 |
| CD79A intracellular domain | MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP | 497 |
| CD79A intracellular domain | MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP | 498 |
| CD79A intracellular domain | MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP | 499 |
| CD79A intracellular domain | ENLYEGLNLDDCSMYEDISRG | 500 |
| CD8 intracellular domain | FVPVFLPAKPTTTPAPRPPTPAPTIASQPLSLRPEACRPAAGGAVHTRGLDFACDIYIWAPLAGTCGVLLLSLVITLYCNHRNR | 501 |
| CD8 intracellular domain | FVPVFLPAKPITTPAPRPPTPAPTIASQPLSLRPEACRPAAGGAVHTRGLDFACDIYIWAPLAGTCGVLLLSLVITLYCNHRNR | 502 |
| CD8a intracellular domain | PTTTPAPRPPTPAPTIASQPLSLRPEACRPAAGGAVHTRGLDFACDI | 503 |
| CTLA4 intracellular domain | AVSLSKMLKKRSPLTTGVFVKMAPTEAECEKQFQPYFIPIN | 504 |
| CTLA4 intracellular domain | AVSLSKMLKKRSPLTTGVYMNMTPRRPECEKQFQPYAPPRDFAAYRS | 505 |
| DAP10 intracellular domain | RPRRSPAQDGKVYINMPGRG | 506 |
| DAP12 intracellular domain | MGGLEPCSRLLLLPLLLAVSGLRPVQAQAQSDCSCSTVSPGVLAGIVMGDLVLTVLIALAVYFLGRLVPRGRGAAEEAATRKQRITETESPYQELQGQRSDVYSDLNTQRPYYK | 507 |
| DAP12 intracellular domain | MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK | 508 |
| DAP12 intracellular domain | MGGLEPCSRLLLLPLLLAVSDCSCSTVSPGVLAGIVMGDLVLTVLIALAVYFLGRLVPRGRGAAEEAATRKQRITETESPYQELQGQRSDVYSDLNTQRPYYK | 509 |
| DAP12 intracellular domain | MGGLEPCSRLLLLPLLLAVSDCSCSTVSPGVLAGIVMGDLVLTVLIALAVYFLGRLVPRGRGAAEATRKQRITETESPYQELQGQRSDVYSDLNTQRPYYK | 510 |
| DAP12 intracellular domain | MGGLEPCSRLLLLPLLLAVSGLRPVQAQAQSDCSCSTVSPGVLAGIVMGDLVLTVLIALAVYFLGRLVPRGRGAAEEAATRKQRITETESPYQELQGQRSDVYSDLNTQRPYYK | 511 |
| DAP12 intracellular domain | MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK; | 512 |
| DAP12 intracellular domain | MGGLEPCSRLLLLPLLLAVSDCSCSTVSPGVLAGIVMGDLVLTVLIALAVYFLGRLVPRGRGAAEEAATRKQRITETESPYQELQGQRSDVYSDLNTQRPYYK | 513 |

TABLE 14-continued

Intracellular signaling and co-stimulatory domains

| Description | Amino Acid Sequence | Amino Acid SEQ ID |
|---|---|---|
| DAP12 intracellular domain | MGGLEPCSRLLLLPLLLAVSDCSCSTVSPGVLAGIVMGDL VLTVLIALAVYFLGRLVPRGRGAAEATRKQRITETESPYQ ELQGQRSDVYSDLNTQRPYYK | 514 |
| DAP12 intracellular domain | ESPYQELQGQRSDVYSDLNTQ | 515 |
| DAP12 intracellular domain | ESPYQELQGQRSDVYSDLNTQ | 516 |
| GITR intracellular domain | RSQCMWPRETQLLLEVPPSTEDARSCQFPEEERGERSAEE KGRLGDLWV | 517 |
| ICOS intracellular domain | TKKKYSSSVHDPNGEFMFMRAVNTAKKSRLTDVTL | 518 |
| IL15Ra intracellular domain | KSRQTPPLASVEMEAMEALPVTWGTSSRDEDLENCSHHL | 519 |
| OX40-CD3 Zeta intracellular domain | RRDQRLPPDAHKPPGGGSFRTPIQEEQADAHSTLAKIRVK FSRSADAPAYQQGQNQLYNELNLGRREEYDVLDKRRGR DPEMGGKPRRKNPQEGLYNELQKDKMAEAYSEIGMKGE RRRGKGHDGLYQGLSTATKDTYDALHMQALPPR | 520 |
| ZAP70 intracellular domain | MPDPAAHLPFFYGSISRAEAEEHLKLAGMADGLFLLRQCL RSLGGYVLSLVHDVRFHHFPIERQLNGTYAIAGGKAHCGP AELCEFYSRDPDGLPCNLRKPCNRPSGLEPQPGVFDCLRD AMVRDYVRQTWKLEGEALEQAIISQAPQVEKLIATTAHE RMPWYHSSLTREEAERKLYSGAQTDGKFLLRPRKEQGTY ALSLIYGKTVYHYLISQDKAGKYCIPEGTKFDTLWQLVEY LKLKADGLIYCLKEACPNSSASNASGAAAPTLPAHPSTLT HPQRRIDTLNSDGYTPEPARITSPDKPRPMPMDTSVYESPY SDPEELKDKKLFLKRDNLLIADIELGCGNFGSVRQGVYRM RKKQIDVAIKVLKQGTEKADTEEMMREAQIMHQLDNPYI VRLIGVCQAEALMLVMEMAGGGPLHKFLVGKREEIPVSN VAELLHQVSMGMKYLEEKNFVHRDLAARNVLLVNRHYA KISDFGLSKALGADDSYYTARSAGKWPLKWYAPECINFR KFSSRSDVWSYGVTMWEALSYGQKPYKKMKGPEVMAFI EQGKRMECPPECPPELYALMSDCWIYKWEDRPDFLTVEQ RMRACYYSLASKVEGPPGSTQKAEAACA | 521 |
| CD28 intracellular domain | MLRLLLALNLFPSIQVTGNKILVKQSPMLVAYDNAVNLSC KYSYNLFSREFRASLHKGLDSAVEVCVVYGNYSQQLQVY SKTGFNCDGKLGNESVTFYLQNLYVNQTDIYFCKIEVMYP PPYLDNEKSNGTIIHVKGKHLCPSPLFPGPSKPFWVLVVVG GVLACYSLLVTVAFIIFWVR | 522 |
| 4-1BB intracellular domain | MGNSCYNIVATLLLVLNFERTRSLQDPCSNCPAGTFCDNN RNQICSPCPPNSFSSAGGQRTCDICRQCKGVFRTRKECSST SNAECDCTPGFHCLGAGCSMCEQDCKQGQELTKKGCKD CCFGTFNDQKRGICRPWTNCSLDGKSVLVNGTKERDVVC GPSPADLSPGASSVTPPAPAREPGHSPQIISFFLALTSTALLF LLFFLTLRFSVVKRGRKKLLYIFKQPFMRPVQTTQEEDG | 523 |
| Fc epsilon Receptor I gamma chain intracellular domain | MIPAVVLLLLLLVEQAAALGEPQLCYILDAILFLYGIVLTL LYCRLKIQVRKAAITSYEKSDGVYTGLSTRNQETYETLKH EKPPQ | 524 |
| Fc epsilon Receptor I gamma chain intracellular domain | DGVYTGLSTRNQETYETLKHE | 525 |
| Fc epsilon Receptor I gamma chain intracellular domain | DPKLCYILDAILFLYGIVLTLLYCRLKIQVRKAAITSYEKSD GVYTGLSTRNQETYETLKHEKPPQ | 526 |
| Fc epsilon Receptor I gamma chain intracellular domain | DGVYTGLSTRNQETYETLKHE | 527 |

Transmembrane Domains

In some embodiments, the CAR of the present invention may comprise a transmembrane domain. As used herein, the term "Transmembrane domain (TM)" refers broadly to an amino acid sequence of about 15 residues in length which spans the plasma membrane. More preferably, a transmembrane domain includes at least 20, 21, 22, 23, 24, 25, 26, 27, 28, 29, 30, 31, 32, 33, 34, 35, 36, 37, 38, 39, 40, 41, 42, 43, 44, or 45 amino acid residues and spans the plasma membrane. In some embodiments, the transmembrane domain of the present invention may be derived either from a natural or from a synthetic source. The transmembrane domain of a CAR may be derived from any naturally membrane-bound or transmembrane protein. For example, the transmembrane region may be derived from (i.e. comprise at least the transmembrane region(s) of) the alpha, beta or zeta chain of the T-cell receptor, CD3 epsilon, CD4, CD5, CD8, CD8a, CD9, CD16, CD22, CD33, CD28, CD37, CD45, CD64, CD80, CD86, CD134, CD137, CD152, or CD154.

Alternatively, the transmembrane domain of the present invention may be synthetic. In some aspects, the synthetic sequence may comprise predominantly hydrophobic residues such as leucine and valine.

In some embodiments, the transmembrane domain of the present invention may be selected from the group consisting of a CD8a transmembrane domain, a CD4 transmembrane domain, a CD 28 transmembrane domain, a CTLA-4 transmembrane domain, a PD-1 transmembrane domain, and a human $Ig_{G4}$ Fc region. As non-limiting examples, the transmembrane domain may be a CTLA-4 transmembrane domain comprising the amino acid sequences of SEQ ID NOs.: 1-5 of International Patent Publication NO.: WO2014/100385; and a PD-1 transmembrane domain comprising the amino acid sequences of SEQ ID NOs.: 6-8 of International Patent Publication NO.: WO2014100385; the contents of each of which are incorporated herein by reference in their entirety.

In some embodiments, the CAR of the present invention may comprise an optional hinge region (also called spacer). A hinge sequence is a short sequence of amino acids that facilitates flexibility of the extracellular targeting domain that moves the target binding domain away from the effector cell surface to enable proper cell/cell contact, target binding and effector cell activation (Patel et al., Gene Therapy, 1999; 6: 412-419). The hinge sequence may be positioned between the targeting moiety and the transmembrane domain. The hinge sequence can be any suitable sequence derived or obtained from any suitable molecule. The hinge sequence may be derived from all or part of an immunoglobulin (e.g., IgG1, IgG2, IgG3, IgG4) hinge region, i.e., the sequence that falls between the CHI and CH2 domains of an immunoglobulin, e.g., an IgG4 Fc hinge, the extracellular regions of type 1 membrane proteins such as CD8a CD4, CD28 and CD7, which may be a wild type sequence or a derivative. Some hinge regions include an immunoglobulin CH3 domain or both a CH3 domain and a CH2 domain. In certain embodiments, the hinge region may be modified from an IgG1, IgG2, IgG3, or IgG4 that includes one or more amino acid residues, for example, 1, 2, 3, 4 or 5 residues, substituted with an amino acid residue different from that present in an unmodified hinge. Table 15 provides various transmembrane regions that can be used in the CARs described herein.

TABLE 15

Transmembrane domains

| Transmembrane domain | Amino Acid Sequence | SEQ ID NO. |
|---|---|---|
| CD8 Transmembrane domain | TTTPAPRPPTPAPTIASQPLSLRPEACRPAAGGAVHTRGLDF ACDI | 528 |
| 2B4 Transmembrane domain | FLVIIVILSALFLGTLACFCV | 577 |
| 4-1BB Transmembrane domain | IISFFLALTSTALLFLLFFLTLRFSVVKRGR | 529 |
| 4-1BB Transmembrane domain | IISFFLALTSTALLFLLFFLTLRFSVV | 530 |
| CD134(OX40) Transmembrane domain | VAAILGLGLVLGLLGPLAILLALYLL | 531 |
| CD148 Transmembrane and intracellular domain | AVFGCIFGALVIVTVGGFIFWRKKRKDAKNNEVSFSQIKPK KSKLIRVENFEAYFKKQQADSNCGFAEEYEDLKLVGISQPK YAAELAENRGKNRYNNVLPYDISRVKLSVQTHSTDDYINA NYMPGYHSKKDFIATQGPLPNTLKDFWRMVWEKNVYAII MLTKCVEQGRTKCEEYWPSKQAQDYGDITVAMTSEIVLPE VVTIRDFTVKNIQTSESHPLRQFHFTSWPDHGVPDTTDLLIN FRYLVRDYMKQSPPESPILVHCSAGVGRTGTFIAIDRLIYQI ENENTVDVYGIVYDLRMHRPLMVQTEDQYVFLNQCVLDI VRSQKDSKVDLIYQNTTAMTIYENLAPVTTFGKTNGYIA | 532 |
| CD148 Transmembrane domain | AVFGCIFGALVIVTVGGFIFW | 533 |
| CD2 Transmembrane domain | KEITNALETWGALGQDINLDIPSFQMSDDIDDIKWEKTSDK KKIAQFRKEKETFKEKDTYKLFKNGTLKIKHLKTDDQDIYK VSIYDTKGKNVLEKIFDLKIQERVSKPKISWTCINTTLTCEV MNGTDPELNLYQDGKHLKLSQRVITHKWTTSLSAKFKCTA GNKVSKESSVEPVSCPEKGLD | 534 |

TABLE 15-continued

Transmembrane domains

| Transmembrane domain | Amino Acid Sequence | SEQ ID NO. |
|---|---|---|
| CD28 Transmembrane and intracellular domain | IEVMYPPPYLDNEKSNGTITHVKGKHLCPSPLFPGPSKPFW VLVVVGGVLACYSLLVTVAHIFWVRSKRSRLLHSDYMNM TPRRPGPTRKHYQPYAPPRDFAAYRS | 535 |
| CD28 Transmembrane domain | FWVLVVVGGVLACYSLLVTVAFIIFWV | 536 |
| CD28 Transmembrane domain | IEVMYPPPYLDNEKSNGTIIHVKGKHLCPSPLFPGPSKPFWV LVVVGGVLACYSLLVTVAFIIFWV | 537 |
| CD28 Transmembrane domain | IFWVLVVVGGVLACYSLLVTVAFIIFWVRSKRR | 538 |
| CD28 Transmembrane domain | FWVLVVVGGVLACYSLLVTVAFIIFWVRSKRSRLLHSDYM NMTPRRPGPTRKHYQPYAPPRDFAAYRS | 539 |
| CD28 Transmembrane domain | MFWVLVVVGGVLACYSLLVTVAFIIFWV | 540 |
| CD28 Transmembrane domain | FWVLVVVGGVLACYSLLVTVAFHFWV | 541 |
| CD28 Transmembrane domain | FWVLVVVGGVLACYSLLVTVAFIIFWVRSKRSRLLHSDYM NMTPRRPGPTRKHYQAYAAARDFAAYRS | 578 |
| CD28 Transmembrane domain | IEVMYPPPYLDNEKSNGTIIHVKGKHLCPSPLFPGPSKPFWV LWVGGVLACYSLLVTVAFIIFWVRSKRSRLLHSDYMNMTP RRPGPTRKHYQPYAPPRDFAAYRS | 579 |
| CD28 Transmembrane domain | MFWVLVVVGGVLACYSGGVTVAFIIFWV | 542 |
| CD28 Transmembrane domain | WVLVVVGGVLACYSLLVTVAFIIFWV | 543 |
| CD28 Transmembrane domain | FWVLVVVGGVLACYSLLVTVAFIIFWVR | 580 |
| CD28 Transmembrane domain | PFWVLVVVGGVLACYSLLVTVAFIIFWVRSKRSRLLHSDY MNMTPRRPGPTRKHYQPYAPPRDFAAYRS | 544 |
| CD28 Transmembrane domain and CD28 and CD34 Zeta intracellular domain | FWVLVVVGGVLACYSLLVTVAFIIFWVRSKRSRLLHSDYM NMTPRRPGPTRKHYQPYAPPRDFAAYRSRVKFSRSADAPA YQQGQNQLYNELNLGRREEYDVLDKRRGRDPEMGGKPRR KNPQEGLYNELQKDKMAEAYSEIGMKGERRRGKGHDGLY QGLSTATKDTYDALHMQALPPR | 545 |
| CD28 Transmembrane domain and CD28, OX40, and CD3 Zeta intracellular domain | FWVLVVVGGVLACYSLLVTVAFIIFWVRSKRSRLLHSDYM NMTPRRPGPTRKHYQPYAPPRDFAAYRSRDQRLPPDAHKP PGGGSFRTPIQEEQADAHSTLAKIRVKFSRSADAPAYQQGQ NQLYNELNLGRREEYDVLDKRRGRDPEMGGKPRRKNPQE GLYNELQKDKMAEAYSEIGMKGERRRGKGHDGLYQGLST ATKDTYDALHMQALPPR | 546 |
| CD28 Transmembrane domain and CD3 Zeta intracellular domain | FWVLVVVGGVLACYSLLVTVAFIIFWVRRVKFSRSADAPA YQQGQNQLYNELNLGRREEYDVLDKRRGRDPEMGGKPRR KNPQEGLYNELQKDKMAEAYSEIGMKGERRRGKGHDGLY QGLSTATKDTYDALHMQALPPR | 547 |
| CD28 transmembrane-CD3 zeta signaling domain ("28z") | AAAIEVMYPPPYLDNEKSNGTIIHVKGKHLCPSPLFPGPSKP FWVLVVVGGVLACYSLLVTVAFIIFWVRSKRSRLLHSDYM NMTPRRPGPTRKHYQPYAPPRDFAAYRSRVKFSRSADAPA YQQGQNQLYNELNLGRREEYDVLDKRRGRDPEMGGKPRR KNPQEGLYNELQKDKMAEAYSEIGMKGERRRGKGHDGLY QGLSTATKDTYDALHMQALPPR | 548 |
| CD3 zeta Transmembrane domain | LCYLLDGILFIYGVILTALFLRV | 549 |
| CD3 zeta Transmembrane domain | MKWKALFTAAILQAQLPITEAQSFGLLDPKLCYLLDGILFIY GVILTALFL | 550 |

TABLE 15-continued

Transmembrane domains

| Transmembrane domain | Amino Acid Sequence | SEQ ID NO. |
|---|---|---|
| CD3 zeta Transmembrane domain | LCYLLDGILFIYGVILTALFL | 551 |
| CD4 Transmembrane domain | ALIVLGGVAGLLLFIGLGIFFCVRC | 552 |
| CD4 Transmembrane domain | MALIVLGGVAGLLLFIGLGIFF | 553 |
| CD45 Transmembrane and intracellular domain | ALIAFLAFLIIVTSIALLVVLYKIYDLHKKRSCNLDEQQELV ERDDEKQLMNVEPIHADILLETYKRKIADEGRLFLAEFQSIP RVFSKFPIKEARKPFNQNKNRYVDILPYDYNRVELSEINGD AGSNYINASYIDGFKEPRKYIAAQGPRDETVDDFWRMIWE QKATVIVMVTRCEEGNRNKCAEYWPSMEEGRAFGDVVV KINQHKRCPDYIIQKLNIVNKKEKATGREVTHIQFTSWPDH GVPEDPHLLLKLRRRVNAFSNFFSGPIWHCSAGVGRTGTYI GIDAMLEGLEAENKVDVYGYVVKLRRQRCLMVQVEAQYI LIHQALVEYNQFGETEVNLSELHPYLHNMKKRDPPSEPSPL EAEFQRLPSYRSWRTQHIGNQEENKSKNRNSNVIPYDYNR VPLKHELEMSKESEHDSDESSDDDSDSEEPSKYINASFIMSY WKPEVMIAAQGPLKETIGDFWQMIFQRKVKVIVMLTELKH GDQEICAQYWGEGKQTYGDIEVDLKDTDKSSTYTLRVFEL RHSKRKDSRTVYQYQYTNWSVEQLPAEPKELISMIQWKQK LPQKNSSEGNKHHKSTPLLIHCRDGSQQTGIFCALLNLLES AETEEWDIFQWKALRKARPGMVSTFEQYQFLYDVIASTYP AQNGQVKKNNHQEDKIEFDNEVDKVKQDANCVNPLGAPE KLPEAKEQAEGSEPTSGTEGPEHSVNGPASPALNQGS | 554 |
| CD62L Transmembrane domain | PLFIPVAVMVTAFSGLAFIIWLA | 555 |
| CD7 Transmembrane domain | ALPAALAVISFLLGLGLGVACVLA | 556 |
| CD8 Transmembrane domain | MALPVTALLLPLALLLHAARP | 557 |
| CD8 Transmembrane domain and CD28 signaling domain | AAAFVPVFLPAKPTTTPAPRPPTPAPTIASQPLSLRPEACRPA AGGAVHTRGLDFACDIYIWAPLAGTCGVLLLSLVITLYCN HRNRSKRSRLLHSDYMNMTPRRPGPTRKHYQPYAPPRDFA AYRSRFSVVKRGRKKLLYIFKQPFMRPVQTTQEEDGCSCRF PEEEEGGCELRVKFSRSADAPAYQQGQNQLYNELNLGRRE EYDVLDKRRGRDPEMGGKPRRKNPQEGLYNELQKDKMA EAYSEIGMKGERRRGKGHDGLYQGLSTATKDTYDALHMQ ALPPR | 558 |
| CD8 transmembrane domain-CD137 (4-1BB) signaling domain and CD3 zeta signaling domain ("BBz") | AAATTTPAPRPPTPAPTIASQPLSLRPEACRPAAGGAVHTR GLDFACDIYIWAPLAGTCGVLLLSLVITLYCKRGRKKLLYI FKQPFMRPVQTTQEEDGCSCRFPEEEEGGCELRVKFSRSAD APAYKQGQNQLYNELNLGRREEYDVLDKRRGRDPEMGG KPRRKNPQEGLYNELQKDKMAEAYSEIGMKGERRRGKGH DGLYQGLSTATKDTYDALHMQALPPR | 559 |
| CD8a Transmembrane domain | FVPVFLPAKPTTTPAPRPPTPAPTIASQPLSLRPEACRPAAGG AVHTRGLDFACDIYIWAPLAGTCGVLLLSLVITLYCNHRN | 560 |
| CD8a Transmembrane domain | IWAPLAGTCGVLLLSLVITLYC | 561 |
| CD8a Transmembrane domain | IYIWAPLAGTCGVLLLSLVITLYC | 562 |
| CD8a Transmembrane domain | IYIWAPLAGTCGVLLLSLVITLYCR | 563 |
| CD8a Transmembrane domain | PTTTPAPRPPTPAPTIASQPLSLRPEACRPAAGGAVHTRGLD FACDIYIWAPLAGTCGVLLLSLVITLYCN | 564 |
| CD8a Transmembrane domain | IYIWAPLAGTCGVLLLSLVITLVCR | 565 |
| CD8a Transmembrane domain | IYIWAPLAGTCGVLLLSLVIT | 566 |

TABLE 15-continued

Transmembrane domains

| Transmembrane domain | Amino Acid Sequence | SEQ ID NO. |
|---|---|---|
| CD8a Transmembrane domain | IYIWAPLAGTCGVLLLSLVITLY | 567 |
| CD8a Transmembrane domain (NP 001139345.1) | TPAPRPPTPAPTIASQPLSLRPEACRPAAGGAWTRGLDFAC DIYIWAPLAGTCGVLLLSLVITLYCNHRNRRR | 581 |
| CD8b Transmembrane domain | LGLLVAGVLVLLVSLGVAIHLCC | 582 |
| DAP10 Transmembrane domain | ILLAGLVAADAVASLLIVGAVFLCARR | 583 |
| EpoR Transmembrane domain | APVGLVARLADESGHVVLRWLPPPETPMTSHIRYEVDVSA GNGAGSVQRVEILEGRTECVLSNLRGRTRYTFAVRARMAE PSFGGFWSAWSEPVSLLTPSD | 568 |
| FcERI a Transmembrane domain | FFIPLLVVILFAVDTGLFISTQQQVTFLLKIKRRKGFRLLNP HPKPNPKNN | 569 |
| FcERI a-Transmembrane domain | MAPAMESPTLLCVALLFFAPDGVLAVPQKPKVSLNPPWNR IFKGENVTLTCNGNNFFEVSSTKWFHNGSLSEETNSSLNIV NAKFEDSGEYKCQHQQVNESEPVYLEVFSDWLLLQASAEV VMEGQPLFLRCHGWRNWDVYKVIYYKDGEALKYWYENH NISITNATVEDSGTYYCTGKVWQLDYESEPLNITVIKAPRE KYWLQFFIPLLVVILFAVDTGLFISTQQQVTFLLKIKRTRKG FRLLNPHPKPNPKNN | 570 |
| FcERI b-Transmembrane region | MDTESNRRANLALPQEPSSVPAFEVLEISPQEVSSGRLLKSA SSPPLHTWLTVLKKEQEFLGVTQILTAMICLCFGTVVCSVL DISHIEGDIFSSFKAGYPFWGAIFFSISGMLSIISERRNATYLV RGSLGANTASSIAGGTGITILIINLKKSLAYIHIHSCQKFFETK CFMASFSTEIVVMMLFLTILGLGSAVSLTICGAGEELKGNK VPEDRVYEELNIYSATYSELEDPGEMSPPIDL | 571 |
| FcERI g-Transmembrane region | MIPAVVLLLLLLVEQAAALGEPQLCYILDAILFLYGIVLTLL YCRLKIQVRKAAITSYEKSDGVYTGLSTRNQETYETLKHEK PPQ | 572 |
| FcERIa Transmembrane domain | DIFIPLLVVILFAVDTGLFISTQQQVTFLLKIKRTRKGFRLLN PHPKPNPKNNR | 573 |
| GITR Transmembrane domain | PLGWLTVVLLAVAACVLLLTSAQLGLHIWQL | 574 |
| Her2 Transmembrane domain | SIISAVVGILLVVVLGVVFGILII | 575 |
| Her2 Transmembrane domain | CHPECQPQNGSVTCFGPEADQCVACAHYKDPPFCVARCPS GVKPDLSYMPIWKFPDEEGACQPCPINCTHSCVDLDDKGC PAEQRASPLTSIISAVVGILLVVVLGVVFGILI | 576 |
| ICOS Transmembrane domain | FWLPIGCAAFVVVCILGCILI | 584 |
| IgG1 Transmembrane domain | EPKSPDKTHTCPPCPAPPVAGPSVFLFPPKPKDTLMIARTPE VTCVVVDVSHEDPEVKFNWYVDGVEVHNAKTKPREEQY NSTYRVVSVLTVLHQDWLNGKEYKCKVSNKALPAPIEKTI SKAKGQPREPQVYTLPPSRDELTKNQVSLTCLVKGFYPSDI AVEWESNGQPENNYKTTPPVLDSDGSFFLYSKLTVDKSRW QQGNVFSCSVMHEALHNHYTQKSLSLSPGKKD | 585 |
| LAG-3 Transmembrane domain | LLFLILGVLSLLLLVTGAFGF | 586 |
| OX40 Transmembrane domain | VAAILGLGLVLGLLGPLAILL | 587 |
| PD-1 Transmembrane domain | VGWGGLLGSLVLLVWVLAVI | 588 |
| Transmembrane domain | FWALVVVAGVLFCYGLLVTVALCVIWT | 589 |
| CD28 transmembrane and | EIVMYPPPYLDNEKSNGTIIHVKGKHLCPSPLFPGPSKPFWV | 1346 |

TABLE 15-continued

Transmembrane domains

| Transmembrane domain | Amino Acid Sequence | SEQ ID NO. |
|---|---|---|
| signaling domains | LVVVGGVLACYSLLVTVAFIIFWVRSKRSRLLHSDYMNMT PRRPGPTRKHYQPYAPPRDFAAYRS | |
| CD28 Transmembrane domain | VMYPPPYLDNEKSNGTIIHVKGKHLCPSPLFPGPSKPFWVL VVVGGVLACYSLLVTVAFIIFWVR | 1347 |
| CD8 Transmembrane domain | TTTPAPRPPTPAPTIASQPLSLRPEACRPAAGGAVHTRGLDF ACDIYIWAPLAGTCGVLLLSLVITLYC | 1348 |

Hinge region sequences useful in the present invention are provided in Table 16.

TABLE 16

Hinge regions

| Hinge Domain | Amino Acid Sequence | SEQ ID NO. |
|---|---|---|
| Hinge | DKTHT | 590 |
| Hinge | CPPC | 591 |
| Hinge | CPEPKSCDTPPPCPR | 592 |
| Hinge | ELKTPLGDTTHT | 593 |
| Hinge | KSCDKTHTCP | 594 |
| Hinge | KCCVDCP | 595 |
| Hinge | KYGPPCP | 596 |
| C233P Hinge | VEPKSPDKTHTCPPCP | 597 |
| C233S Hinge | LDPKSSDKTHTCPPCP | 598 |
| CD28 Hinge | IEVMYPPPYLDNEKSNGTIIHVKGKHLCPSPLFPGPSKP | 599 |
| CD8a Hinge | GGAVHTRGLDFA | 600 |
| CD8a Hinge | TTTPAPRPPTPAPTIASQPLSLRPEACRPAAGGAVHTRGLD FACD | 601 |
| CD8a Hinge | AKPTTTPAPRPPTPAPTIASQPLSLRPEACRPAAGGAVHTR GLDFACD | 602 |
| CD8a Hinge | TTTPAPRPPTPAPTIASQPLSLRPEACRPAAGGAVHTRGLD FACD | 603 |
| CD8a Hinge | TTTPAPRPPTPAPTIASQPLSLRPEACRPAAGGAVHTRGLD FACD | 604 |
| CD8a Hinge | TTTPAPRPPTPAPTIASQPLSLRPEACRPAAGGAVHTRGLD FACDEPKSPDKTHTCPPCPAPPVAGPSVFLFPPKPKDT | 605 |
| CD8a Hinge | PAKPTTTPAPRPPTPAPTIASQPLSLRPEACRPAAGGAVHT RGLDFACDIY | 606 |
| CD8a Hinge | TTTPAPRPPTPAPTIASQPLSLRPEACRPAAGGAVHTRGLD FACDIYIWAPLAGTCGVLLLSLVITLYC | 607 |
| CD8a Hinge | TTPAPRPPTPAPTIASQPLSLRPEACRPAAGGAVHTRGLDF ACD | 608 |
| CD8a Hinge | TTTPAPRPPTPAPTIASQPLSLRPEACRPAAGGAVHTRGLD FACDIY | 609 |
| Delta5 Hinge | LDKTHTCPPCP | 610 |

TABLE 16-continued

Hinge regions

| Hinge Domain | Amino Acid Sequence | SEQ ID NO. |
|---|---|---|
| EpoR Hinge | APVGLVARLADESGHVVLRWLPPPETPMTSHIRYEVDVS AGNGAGSVQRVEILEGRTECVLSNLRGRTRYTFAVRARM AEPSFGGFWSAWSEPVSLLTPSD | 611 |
| FCRIIαHinge | GLAVSTISSFFPPGYQ | 612 |
| FcγRIIIαHinge | GLAVSTISSFFPPGYQ | 613 |
| Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 614 |
| Hinge | YVTVSSQDPAEPKSPDKTHTCPPCPAPELLGGPSVFLFPPK PKDTLMISRTPEVTCVVVDVSHEDPEVKFNWYVDGVEVH NAKTKPREEQYNSTYRVVSVLTVLHQDWLNGKEYKCKV SNKALPAPIEKTISKAKGQPREPQVYTLPPSRDELTKNQVS LTCLVKGFYPSDIAVEWESNGQPENNYKTTPPVLDSDGSF FLYSKLTVDKSRWQQGNVFSCSVMHEALHNHYTQKSLSL SPGKKDPK | 615 |
| Hinge | KPTTTPAPRPPTPAPTIASQPLSLRPEACRPAAGGAVHTRG LDFA | 616 |
| Hinge | LEPKSCDKTHTCPPCP | 617 |
| Hinge | KPTTTPAPRPPTPAPTIASQPLSLRPEACRPAAGGAVHTRG LD | 618 |
| Hinge | EPKSCDKTHTCPPCP | 619 |
| Hinge | ELKTPLGDTHTCPRCP | 620 |
| Hinge | EPKSCDTPPPCPRCP | 621 |
| Hinge | ESKYGPPCPSCP | 622 |
| Hinge | ERKCCVECPPCP | 623 |
| Hinge | ELKTPLGDTHTCPRCP | 1105 |
| Hinge | EPKSCDTPPPCPRCP | 1106 |
| Hinge | ESKYGPPCPSCP | 1107 |
| Hinge(CH2-CH3) | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGK | 624 |
| Hinge(CH3) | ESKYGPPCPPCPGQPREPQVYTLPPSQEEMTKNQVSLTCL VKGFYPSDIAVEWESNGQPENNYKTTPPVLDSDGSFFLYS RLTVDKSRWQEGNVFSCSVMHEALHNHYTQKSLSLSLGK | 625 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 626 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLHPSL PPQRLMALREPAAQAPVKLSLNLLASSDPPEAASWLLCEV | 627 |

TABLE 16-continued

Hinge regions

| Hinge Domain | Amino Acid Sequence | SEQ ID NO. |
|---|---|---|
| | SGFSPPNILLMWLEDQREVNTSGFAPARPPPQPGSTTFWA WSVLRVPAPPSPQPATYTCVVSHEDSRTLLNASRSLEVSY VTDH | |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMVVLEDQREVNTSGFAPARPPPQPGSTTFW AWSVLRVPAPPSPQPATYTCVVSHEDSRTLLNASRSLEVS YVTDH | 628 |
| IgD Hinge | ESPKAQASSVPTAQPQAEGSLAKATTAPATTRNTGRGGEE KKKEKEKEEQEERETKTP | 629 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 630 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 631 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 632 |
| IgD Hinge | RWPESPKAQASSVPTAQPQAEGSLAKATTAPAT TRNTGRGGEEKKKEKEKEEQEERETKTPECPSH TQPLGVYLLTPAVQDLWLRDKATFTCFVVGSD LKDAHLTWEVAGKVPTGGVEEGLLERHSNGSQ SQHSRLTLPRSLWNAGTSVTCTLNHPSLPPQRL MALREPAAQAPVKLSLNLLASSDPPEAASWLLC EVSGFSPPNILLMWLEDQREVNTSGFAPARPPQP GSTTFWAWSVLRVPAPPSPQPATYTCVVSHEDS RTLLNASRSLEVSYVTDH | 1117 |
| IgD Hinge | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 633 |
| IgG1(CH2CH3) Hinge domain | AEPKSPDKTHTCPPCPAPPVAGPSVFLFPPKPKDTLMIART PEVTCVVVDVSHEDPEVKFNWYVDGVEVHNAKTKPREE QYNSTYRVVSVUTVLHQDWLNGKEYKCKVSNKALPAPIE KTISKAKGQPREPQVYTLPPSRDELTKNQVSLTCLVKGFY PSDIAVEWESNGQPENNYKTTPPVLDSDGSFFLYSKLTVD KSRWQQGNVFSCSVMHEALHNHYTQKSLSLSPGKKD | 2741 |
| IgG1(CH2CH3) Hinge domain | AEPKSPDKTHTCPPCPAPPVAGPSVFLFPPKPKDTLMIART PEVTCVVVDVSHEDPEVKFNWYVDGVEVHNAKTKPREE QYNSTYRVVSVLTVLHQDWLNGKEYKCKVSNKALPAPIE KTISKAKGQPREPQVYTLPPSRDELTKNQVSLTCLVKGFY PSDIAVEWESNGQPENNYKTTPPVLDSDGSFFLYSKLTVD KSRWQQGNVFSCSVMHEALHNHYTQKSLSLSPGKKD | 635 |

TABLE 16-continued

Hinge regions

| Hinge Domain | Amino Acid Sequence | SEQ ID NO. |
|---|---|---|
| IgG1 Hinge | AEPKSPDKTHTCPPCPKDPK | 636 |
| IgG1 Hinge | EPKSCDKTHTCPPCP | 637 |
| IgG1 Hinge | EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEVKCKVSNKALPAPIEKTISKAKGQPREPQVYTLPPSRDELTKNQVSLTCLVKGFYPSDIAVEWESNGQPENNYKTTPPVLDSDGSFFLVSKLTVDKSRWQQGNVFSCSVMHEALHNHYTQKSLSLSPGKKD | 638 |
| IgG1 Hinge | SVFLFPPKPKDTL | 639 |
| IgG1 Hinge | EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK | 640 |
| IgG1 Hinge | EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK | 641 |
| IgG1 Hinge | VECPPCPAPPVAGPSVFLFPPKPKDTLMISRRPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 642 |
| IgG1 Hinge (CH2CH3 domain) | DPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK | 643 |
| IgG2 Hinge | ERKCCVECPPCP | 644 |
| IgG3 Hinge | ELKTPLGDTTHTCPRCP | 645 |
| IgG3 Hinge | ELKTPLGDTTHTCPRCPEPKSCDTPPPCPRCPEPKSCDTPPPCPRCPEPKSCDTPPPCPRCP | 646 |
| IgG4 (CH2 and CH3) | ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM | 647 |
| IgG4 (CH2 and CH3) | ESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM | 648 |
| IgG4 Hinge | SPNMVPHAHHAQ | 649 |
| IgG4 Hinge | GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 650 |
| IgG4 Hinge | ESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 651 |

TABLE 16-continued

Hinge regions

| Hinge Domain | Amino Acid Sequence | SEQ ID NO. |
|---|---|---|
| IgG4 Hinge | ESKYGPPCPSCPAPEFEGGPSVFLFPPKPKDTLMISRTPEVT CVVVDVSQEDPEVQFNWYVDGVEVHQAKTKPREEQFNS TYRVVSVLTVLHQDWLNGKEYKCKVSNKGLPSSIEKTISK AKGQPREPQVYTLPPSQEEMTKNQVSLTCLVKGFVPSDIA VEWESNGQPENNYKTTPPVLDSDGSFFLYSRLTVDKSRW QEGNVFSCSVMHEALHNHYTQKSLSLSLGK | 652 |
| IgG4 Hinge | ESKYGPPCPPCPAPEFEGGPSVFLFPPKPKDTLMISRTPEVT CVVVDVSQEDPEVQFNWYVDGVEVHQAKTKPREEQFNS TYRVVSVLTVLHQDWLNGKEYKCKVSNKGLPSSIEKTISK AKGQPREPQVYTLPPSQEEMTKNQVSLTCLVKGFVPSDIA VEWESNGQPENNYKTTPPVLDSDGSFFLYSRLTVDKSRW QEGNVFSCSVMHEALHNHYTQKSLSLSLGK | 653 |
| IgG4 Hinge | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGKM | 654 |
| IgG4 Hinge | GAATCTAAGTACGGACCGCCCTGCCCCCCTTGCCCT | 655 |
| IgG4 Hinge | ESKYGPPCPPCP | 656 |
| IgG4 Hinge | ESKYGPPCPPCPGQPREPQVYTLPPSQEEMTKNQVSLTCL VKGFYPSDIAVEWESNGQPENNYKTTPPVLDSDGSFFLYS RLTVDKSRWQEGNVFSCSVMHEALHNHYTQKSLSLSLGK | 657 |
| IgG4 Hinge | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGK | 658 |
| IgG4 Hinge | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGK | 659 |
| IgG4 Hinge | ESKYGPPCPPCP | 660 |
| IgG4 Hinge | YGPPCPPCP | 661 |
| IgG4 Hinge | KYGPPCPPCP | 662 |
| IgG4 Hinge | EVVKYGPPCPPCP | 663 |
| IgG4 Hinge | ESKYGPPCPSCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDLSRW QEGNVFSCSVMHEALHNHYTQKSLSLSLGK | 664 |
| IgG4 Hinge and Linker | ESKYGPPCPPCPGGGSSGGGSG | 665 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTIPPVLDSDGSFFLYSKLTVDKS RWQQGNVFSCSVMHEALHNHYTQKSLSLSPGK | 666 |
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTIPPVLDSDGSFFLYSKLTVDKS RWQQGNVFSCSVMHEALHNHYTQKSLSLSPGK | 667 |

TABLE 16-continued

Hinge regions

| Hinge Domain | Amino Acid Sequence | SEQ ID NO. |
|---|---|---|
| IgG1 Hinge | EPKSPDKTHTCPPCPAPPVAGPSVFLFPPKPKDTLMIARTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTTPPVLDSDGSFFLYSKLTVDKS RWQQGNVFSCSVMHEALHNHYTQKSLSLSPGK | 668 |
| CH2CH3 spacer domain | EPKSCDKTHTCPPCPAPELLGGPSVFLFPPKPKDTLMISRTP EVTCVVVDVSHEDPEVKFNWYVDGVEVHNAKTKPREEQ YNSTYRVVSVLTVLHQDWLNGKEYKCKVSNKALPAPIEK TISKAKGQPREPQVYTLPPSRDELTKNQVSLTCLVKGFYPS DIAVEWESNGQPENNYKTTPPVLDSDGSFFLYSKLTVDKS RWQQGNVFSCSVMHEALHNHYTQKSLSLSPGKKDPK | 1145 |

Hinge and transmembrane region sequences useful in the present invention are provided in Table 17.

TABLE 17

Hinge and Transmembrane regions

| Hinge Domain | Amino Acid Sequence | SEQ ID NO. |
|---|---|---|
| CD8a Transmembrane and Hinge | TTPAPRPPTPAPTIASQPLSLRPEACRPAAGGAVHTRGLDF ACDIYIWAPLAGTCGVLLLSLVITLYC | 1349 |
| CD8a Transmembrane and Hinge | DIQMTQSSSYLSVSLGGRVTITCKASDHINNWLAWYQQK PGNAPRLLISGATSLETGVPSRFSGSGSGKDYTLSITSLQTE DVATYYCQQYWSTPFTFGSGTKLEIKGGGGSGGGGSGGG GSQVQLKESGPGLVAPSQSLSITSTVSGFSLSRYSVHWVR QPPGKGLEWLGMIWGGGSTDYNSALKSRLSISKDNSKSQ VFLKMNSLQTDDTAMYYCARNEGDTTAGTWFAYWGQG TLVTVSS | 1350 |
| CD8a Transmembrane and Hinge | ALSNSIMYFSHFVPVFLPAKPTTTPAPRPPTPAPTIASQPLS LRPEACRPAAGGAVHTRGLD | 1351 |
| CD8a Transmembrane and Hinge | TTTPAPRPPTPAPTIASQPLSLRPEACRPAAGGAVHTRGLD FACDIYIWAPLAGTCGVLLLSLVITLY | 1352 |
| CD8a Transmembrane and Hinge | KPTTTPAPRPPTPAPTIASQPLSLRPEACRPAAGGAVHTRG LDFACDIYIWAPLAGTCGVLLLSLVITLY | 1353 |

In some embodiments, the CAR of the present invention may comprise one or more linkers between any of the domains of the CAR. The linker may be between 1-30 amino acids long. In this regard, the linker may be 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acids in length. In other embodiments, the linker may be flexible.

In some embodiments, the CH2CH3 may be preferentially excluded from the chimeric antigen structure to elicit a higher TNFa response as disclosed in WO2016149578 (the contents of which are herein incorporated by reference). In some constructs a CH2CH3 structural domain is included. This domain extends the scFV away from the plasma membrane extracellular surface, and allows for the efficient detection of transduced T cells with anti-IgG Fc-specific antibody. CAR constructs which include CH2CH3 domain are disclosed in WO2015069922A3 (the contents of which are incorporated herein by reference in its entirety).

In some embodiments, the components including the targeting moiety, transmembrane domain and intracellular signaling domains of the present invention may be constructed in a single fusion polypeptide. The fusion polypeptide may be the payload of an effector module of the invention. In some embodiments, more than one CAR fusion polypeptides may be included in an effector module, for example, two, three or more CARs may be included in the effector module under the control of a single SRE (e.g., a DD). Representative effector modules comprising the CAR payload are illustrated in FIG. 2-FIG. 6.

In some embodiments, the CAR sequences may be selected from Table 18.

TABLE 18

CAR sequences

| Description | SEQ ID NO | Source |
|---|---|---|
| CD19 CAR | 4864 | SEQ ID NO: 12 in U.S. Pat. No. 9,499,629B2 |
| CD19 CAR | 4865 | SEQ ID NO: 24 in US20160333108A1 |
| CD19 CAR | 4866 | SEQ ID NO: 25 in US20160333108A1 |
| CD19 CAR | 4867 | SEQ ID NO: 26 in US20160333108A1 |
| CD19 CAR | 4868 | SEQ ID NO: 27 in US20160333108A1 |
| CD19 CAR | 4869 | SEQ ID NO: 1 in EP2997134A4 |

TABLE 18-continued

CAR sequences

| Description | SEQ ID NO | Source |
|---|---|---|
| CD19 CAR | 4870 | SEQ ID NO: 19 in EP3071687A1 |
| CD19 CAR | 4871 | SEQ ID NO: 20 in EP3071687A1 |
| CD19 CAR | 4872 | SEQ ID NO: 181 in WO2016168773A3 |
| CD19 CAR | 4873 | SEQ ID NO: 2 in WO2015157399A9 |
| CD19 CAR | 4874 | SEQ ID NO: 56 in WO2016174409A1 |
| CD19 CAR | 4875 | SEQ ID NO: 62 in WO2016174409A1 |
| CD19 CAR | 4876 | SEQ ID NO: 145 in WO2016179319A1 |
| CD19 CAR | 4877 | SEQ ID NO: 293 in US20160311907A1 |
| CD19 CAR | 4878 | SEQ ID NO: 294 in US20160311907A1 |
| CD19 CAR | 4879 | SEQ ID NO: 295 in US20160311907A1 |
| CD19 CAR | 4880 | SEQ ID NO: 296 in US20160311907A1 |
| CD19 CAR | 4881 | SEQ ID NO: 297 in US20160311907A1 |
| CD19 CAR | 4882 | SEQ ID NO: 298 in US20160311907A1 |
| CD19 CAR | 4883 | SEQ ID NO. 73 in WO2013176915A1 |
| CD19 CAR | 4884 | SEQ ID NO. 73 in WO2013176916A1 |
| CD19 CAR | 4885 | SEQ ID NO. 73 in US20130315884A1 |
| CD19 CAR | 4886 | SEQ ID NO. 73 in US20140134142A1 |
| CD19 CAR | 4887 | SEQ ID NO. 73 in US20150017136A1 |
| CD19 CAR | 4888 | SEQ ID NO. 73 in US20150203817A1 |
| CD19 CAR | 4889 | SEQ ID NO. 73 in US20160120905A1 |
| CD19 CAR | 4890 | SEQ ID NO. 73 in US20160120906A1 |
| CD19 CAR | 4891 | SEQ ID NO. 8 in WO2015124715 |
| CD19 CAR | 4892 | SEQ ID NO. 5 in WO2015124715 |
| CD19 CAR | 4893 | SEQ ID NO. 73 in WO2014184744 |
| CD19 CAR | 4894 | SEQ ID NO. 73 in WO2014184741 |
| CD19 CAR | 4895 | SEQ ID NO. 14 in US20160145337A1 |
| CD19 CAR | 4896 | SEQ ID NO. 15 in US20160145337A1 |
| CD19 CAR | 4897 | SEQ ID NO. 14 in WO2014184143 |
| CD19 CAR | 4898 | SEQ ID NO. 15 in WO2014184143 |
| CD19 CAR | 4899 | SEQ ID NO. 15 in WO2015075175 |
| CD19 CAR | 4900 | SEQ ID NO. 16 in WO2015075175 |
| CD19 CAR | 4901 | SEQ ID NO. 16 in US20160145337A1 |
| CD19 CAR | 4902 | SEQ ID NO. 16 in WO2014184143 |
| CD19 CAR | 4903 | SEQ ID NO 12 in WO2012079000 |
| CD19 CAR | 4904 | SEQ ID NO. 31 in WO2016164580 |
| CD19 CAR | 4905 | SEQ ID NO. 32 in WO2016164580 |
| CD19 CAR | 4906 | SEQ ID NO. 33 in WO2016164580 |
| CD19 CAR | 4907 | SEQ ID NO. 34 in WO2016164580 |
| CD19 CAR | 4908 | SEQ ID NO. 35 in WO2016164580 |
| CD19 CAR | 4909 | SEQ ID NO. 36 in WO2016164580 |
| CD19 CAR | 4910 | SEQ ID NO. 37 in WO2016164580 |
| CD19 CAR | 4911 | SEQ ID NO. 38 in WO2016164580 |
| CD19 CAR | 4912 | SEQ ID NO. 39 in WO2016164580 |
| CD19 CAR | 4913 | SEQ ID NO. 40 in WO2016164580 |
| CD19 CAR | 4914 | SEQ ID NO. 41 in WO2016164580 |
| CD19 CAR | 4915 | SEQ ID NO. 42 in WO2016164580 |
| CD19 CAR | 4916 | SEQ ID NO. 58 in WO2016164580 |
| CD19 CAR | 4917 | SEQ ID NO: 14 in US20160296563A1 |
| CD19 CAR | 4918 | SEQ ID NO: 15 in US20160296563A1 |
| CD19 CAR | 4919 | SEQ ID NO. 31 in WO2015157252 |
| CD19 CAR | 4920 | SEQ ID NO. 32 in WO2015157252 |
| CD19 CAR | 4921 | SEQ ID NO. 33 in WO2015157252 |
| CD19 CAR | 4922 | SEQ ID NO. 34 in WO2015157252 |
| CD19 CAR | 4923 | SEQ ID NO. 35 in WO2015157252 |
| CD19 CAR | 4924 | SEQ ID NO. 36 in WO2015157252 |
| CD19 CAR | 4925 | SEQ ID NO. 37 in WO2015157252 |
| CD19 CAR | 4926 | SEQ ID NO. 38 in WO2015157252 |
| CD19 CAR | 4927 | SEQ ID NO. 39 in WO2015157252 |
| CD19 CAR | 4928 | SEQ ID NO. 40 in WO2015157252 |
| CD19 CAR | 4929 | SEQ ID NO. 41 in WO2015157252 |
| CD19 CAR | 4930 | SEQ ID NO. 42 in WO2015157252 |
| CD19 CAR | 4931 | SEQ ID NO. 14 in WO2016139487 |
| CD19 CAR | 4932 | SEQ ID NO. 15 in WO2016139487 |
| CD19 CAR | 4933 | SEQ ID NO: 53 in US20160250258A1 |
| CD19 CAR | 4934 | SEQ ID NO: 54 in US20160250258A1 |
| CD19 CAR | 4935 | SEQ ID NO: 55 in US20160250258A1 |
| CD19 CAR | 4936 | SEQ ID NO: 56 in US20160250258A1 |
| CD19 CAR | 4937 | SEQ ID NO: 57 in US20160250258A1 |
| CD19 CAR | 4938 | SEQ ID NO: 58 in US20160250258A1 |
| CD19 CAR | 4939 | SEQ ID NO. 1 in WO2015187528 |
| CD19 CAR | 4940 | SEQ ID NO. 2 in WO2015187528 |
| CD19 CAR | 4941 | SEQ ID NO. 3 in WO2015187528 |
| CD19 CAR | 4942 | SEQ ID NO. 4 in WO2015187528 |
| CD19 CAR | 4943 | SEQ ID NO. 5 in WO2015187528 |
| CD19 CAR | 4944 | SEQ ID NO. 6 in WO2015187528 |
| CD19 CAR | 4945 | SEQ ID NO. 7 in WO2015187528 |
| CD19 CAR | 4946 | SEQ ID NO. 8 in WO2015187528 |
| CD19 CAR | 4947 | SEQ ID NO. 9 in WO2015187528 |
| CD19 CAR | 4948 | SEQ ID NO. 10 in WO2015187528 |
| CD19 CAR | 4949 | SEQ ID NO. 11 in WO2015187528 |
| CD19 CAR | 4950 | SEQ ID NO. 12 in WO2015187528 |
| CD19 CAR | 4951 | SEQ ID NO. 13 in WO2015187528 |
| CD19 CAR | 4952 | SEQ ID. NO. 31 in WO2015157252 |
| CD19 CAR | 4953 | SEQ ID. NO. 32 in WO2015157252 |
| CD19 CAR | 4954 | SEQ ID. NO. 33 in WO2015157252 |
| CD19 CAR | 4955 | SEQ ID. NO. 34 in WO2015157252 |
| CD19 CAR | 4956 | SEQ ID. NO. 35 in WO2015157252 |
| CD19 CAR | 4957 | SEQ ID. NO. 36 in WO2015157252 |
| CD19 CAR | 4958 | SEQ ID. NO. 37 in WO2015157252 |
| CD19 CAR | 4959 | SEQ ID. NO. 38 in WO2015157252 |
| CD19 CAR | 4960 | SEQ ID. NO. 39 in WO2015157252 |
| CD19 CAR | 4961 | SEQ ID. NO. 40 in WO2015157252 |
| CD19 CAR | 4962 | SEQ ID. NO. 41 in WO2015157252 |
| CD19 CAR | 4963 | SEQ ID. NO. 42 in WO2015157252 |
| CD19 CAR | 4964 | SEQ ID. NO. 58 in WO2015157252 |
| CD19 CAR | 4965 | SEQ ID NO. 31 in WO2014153270 |
| CD19 CAR | 4966 | SEQ ID NO. 32 in WO2014153270 |
| CD19 CAR | 4967 | SEQ ID NO. 33 in WO2014153270 |
| CD19 CAR | 4968 | SEQ ID NO. 34 in WO2014153270 |
| CD19 CAR | 4969 | SEQ ID NO. 35 in WO2014153270 |
| CD19 CAR | 4970 | SEQ ID NO. 36 in WO2014153270 |
| CD19 CAR | 4971 | SEQ ID NO. 37 in WO2014153270 |
| CD19 CAR | 4972 | SEQ ID NO. 38 in WO2014153270 |
| CD19 CAR | 4973 | SEQ ID NO. 39 in WO2014153270 |
| CD19 CAR | 4974 | SEQ ID NO. 40 in WO2014153270 |
| CD19 CAR | 4975 | SEQ ID NO. 41 in WO2014153270 |
| CD19 CAR | 4976 | SEQ ID NO. 42 in WO2014153270 |
| CD19 CAR (Third generation) | 4977 | SEQ ID NO. 13 in WO2016139487 |

In some embodiments, the CAR sequences may be selected from Table 19.

TABLE 19

CAR sequences

| Description | Source | Target | SEQ ID NO. |
|---|---|---|---|
| ALK CAR | SEQ ID NO. 37 in WO2015069922 | ALK | 4978 |
| ALK CAR | SEQ ID NO. 39 in WO2015069922 | ALK | 4979 |
| ALK CAR | SEQ ID NO. 41 in WO2015069922 | ALK | 4980 |
| ALK CAR | SEQ ID NO. 43 in WO2015069922 | ALK | 4981 |
| ALK CAR | SEQ ID NO. 44 in WO2015069922 | ALK | 4982 |
| ALK CAR | SEQ ID NO. 45 in WO2015069922 | ALK | 4983 |
| ALK CAR | SEQ ID NO. 46 in WO2015069922 | ALK | 4984 |
| ALK CAR | SEQ ID NO. 47 in WO2015069922 | ALK | 4985 |
| ALK CAR | SEQ ID NO. 48 in WO2015069922 | ALK | 4986 |

TABLE 19-continued

CAR sequences

| Description | Source | Target | SEQ ID NO. |
|---|---|---|---|
| ALK CAR | SEQ ID NO. 49 in WO2015069922 | ALK | 4987 |
| ALK CAR | SEQ ID NO. 50 in WO2015069922 | ALK | 4988 |
| ALK CAR | SEQ ID NO. 51 in WO2015069922 | ALK | 4989 |
| ALK CAR | SEQ ID NO. 52 in WO2015069922 | ALK | 4990 |
| ALK CAR | SEQ ID NO. 53 in WO2015069922 | ALK | 4991 |
| ALK CAR | SEQ ID NO. 54 in WO2015069922 | ALK | 4992 |
| ALK CAR | SEQ ID NO. 55 in WO2015069922 | ALK | 4993 |
| ALK CAR | SEQ ID NO. 56 in WO2015069922 | ALK | 4994 |
| ALK CAR | SEQ ID NO. 57 in WO2015069922 | ALK | 4995 |
| ALK CAR | SEQ ID NO. 58 in WO2015069922 | ALK | 4996 |
| ALK CAR | SEQ ID NO. 59 in WO2015069922 | ALK | 4997 |
| ALK CAR | SEQ ID NO. 60 in WO2015069922 | ALK | 4998 |
| ALK CAR | SEQ ID NO. 61 in WO2015069922 | ALK | 4999 |
| ALK CAR | SEQ ID NO. 62 in WO2015069922 | ALK | 5000 |
| ALK CAR | SEQ ID NO. 63 in WO2015069922 | ALK | 5001 |
| ALK CAR | SEQ ID NO. 64 in WO2015069922 | ALK | 5002 |
| ALK CAR | SEQ ID NO. 65 in WO2015069922 | ALK | 5003 |
| ALK CAR | SEQ ID NO. 66 in WO2015069922 | ALK | 5004 |
| ALK CAR | SEQ ID NO. 67 in WO2015069922 | ALK | 5005 |
| ALK CAR | SEQ ID NO. 68 in WO2015069922 | ALK | 5006 |
| ALK CAR | SEQ ID NO. 69 in WO2015069922 | ALK | 5007 |
| ALK CAR | SEQ ID NO. 70 in WO2015069922 | ALK | 5008 |
| ALK CAR | SEQ ID NO. 71 in WO2015069922 | ALK | 5009 |
| ALK CAR | SEQ ID NO. 72 in WO2015069922 | ALK | 5010 |
| ALK CAR | SEQ ID NO. 73 in WO2015069922 | ALK | 5011 |
| ALK CAR | SEQ ID NO. 74 in WO2015069922 | ALK | 5012 |
| ALK CAR | SEQ ID NO. 75 in WO2015069922 | ALK | 5013 |
| ALK CAR | SEQ ID NO. 76 in WO2015069922 | ALK | 5014 |
| ALK CAR | SEQ ID NO. 77 in WO2015069922 | ALK | 5015 |
| ALK CAR | SEQ ID NO. 78 in WO2015069922 | ALK | 5016 |
| ALK CAR | SEQ ID NO. 79 in WO2015069922 | ALK | 5017 |
| ALK CAR | SEQ ID NO. 80 in WO2015069922 | ALK | 5018 |
| ALK CAR | SEQ ID NO. 81 in WO2015069922 | ALK | 5019 |
| ALK CAR | SEQ ID NO. 82 in WO2015069922 | ALK | 5020 |
| ALK CAR | SEQ ID NO. 83 in WO2015069922 | ALK | 5021 |
| ALK CAR | SEQ ID NO. 84 in WO2015069922 | ALK | 5022 |
| ALK CAR | SEQ ID NO. 85 in WO2015069922 | ALK | 5023 |
| ALK CAR | SEQ ID NO. 86 in WO2015069922 | ALK | 5024 |
| ALK CAR | SEQ ID NO. 87 in WO2015069922 | ALK | 5025 |
| ALK CAR | SEQ ID NO. 88 in WO2015069922 | ALK | 5026 |
| ALK CAR | SEQ ID NO. 89 in WO2015069922 | ALK | 5027 |
| ALK CAR | SEQ ID NO. 90 in WO2015069922 | ALK | 5028 |
| CD22 (m971) third generation CAR | SEQ ID NO. 22 in WO2014065961 | CD22 | 5029 |
| CD22 (m971) third generation CAR | SEQ ID NO. 23 in WO2014065961 | CD22 | 5030 |
| CD22 (m971) third generation CAR | SEQ ID NO. 24 in WO2014065961 | CD22 | 5031 |
| CD22 (CARsHA22 28z) CAR | SEQ ID NO. 15 in WO2013059593 | CD22 | 5032 |
| CD22 (HA22 28BBz) CAR | SEQ ID NO. 16 in WO2013059593 | CD22 | 5033 |
| CD22 (HASH22 28z) CAR | SEQ ID NO. 17 in WO2013059593 | CD22 | 5034 |
| CD22 (HASH22 28BBz) CAR | SEQ ID NO. 18 in WO2013059593 | CD22 | 5035 |
| CD22 (BL22 28z) CAR | SEQ ID NO. 19 in WO2013059593 | CD22 | 5036 |
| CD22 (BL22 28BBz) CAR | SEQ ID NO. 20 in WO2013059593 | CD22 | 5037 |
| CD22 (HA22SH-CAR-second generation, version 2) CAR | SEQ ID NO. 32 in WO2013059593 | CD22 | 5038 |
| CD276 CAR (CD276.6 second generation) | SEQ ID NO. 39 in WO2014160627 | CD276 | 5039 |
| CD276 CAR (CD276.1 second generation, version 1) | SEQ ID NO. 42 in WO2014160627 | CD276 | 5040 |
| CD276 CAR (CD276.17 second generation, version 1) | SEQ ID NO. 45 in WO2014160627 | CD276 | 5041 |
| CD276 CAR (CD276.6 CAR second generation, version 1) | SEQ ID NO. 122 in WO2014160627 | CD276 | 5042 |
| CD276 CAR (CD276.6 CAR second generation, version 2) | SEQ ID NO. 123 in WO2014160627 | CD276 | 5043 |
| CD276 CAR (CD276.6 CAR third generation) | SEQ ID NO. 124 in WO2014160627 | CD276 | 5044 |
| CD276 CAR (CD276.1 CAR second generation, version 1) | SEQ ID NO. 125 in WO2014160627 | CD276 | 5045 |
| CD276 CAR (CD276.1 CAR second generation, version 2) | SEQ ID NO. 126 in WO2014160627 | CD276 | 5046 |
| CD276 CAR (CD276.1 CAR third generation) | SEQ ID NO. 127 in WO2014160627 | CD276 | 5047 |

TABLE 19-continued

CAR sequences

| Description | Source | Target | SEQ ID NO. |
|---|---|---|---|
| CD276 CAR (CD276.17 CAR second generation, version 1) | SEQ ID NO. 128 in WO2014160627 | CD276 | 5048 |
| CD276 CAR (CD276.17 CAR second generation, version 2) | SEQ ID NO. 129 in WO2014160627 | CD276 | 5049 |
| CD276 CAR (CD276.17 CAR third generation) | SEQ ID NO. 130 in WO2014160627 | CD276 | 5050 |
| CD 276 CAR | SEQ ID NO. 20 in WO2017044699 | CD276 | 5051 |
| CD276.MG.BB.Z CAR | SEQ ID NO. 12 in WO2017044699 | CD276 | 5052 |

In one embodiment of the present invention, the payload of the invention is a CD19 specific CAR targeting different B cell. In the context of the invention, an effector module may comprise a hDHFR DD, ecDHFR DD, or FKBP DD operably linked to a CD19 CAR fusion construct. In some instances, the promoter utilized to drive the expression of the effector module in the vector may be a CMV promoter or an EF1a. The efficiency of the promoter in driving the expression of the same construct may be compared. For example, two constructs that differ only by their promoter, CMV (in OT-CD19N-001) or EF1a promoter (in OT-CD19N-017) may be compared. The amino acid sequences of CD19 CAR constructs and its components are presented in Table 20 and Table 21. The amino acid sequences in Table 20 and/or Table 21 may comprise a stop codon which is denoted in the table with a "*" at the end of the amino acid sequence.

TABLE 20

Sequences of components of CD19 CARs

| Description | Amino Acid Sequence | Amino Acid SEQ ID NO | Nucleic Acid SEQ ID NO |
|---|---|---|---|
| CD19 scFv | DIQMTQTTSSLSASLGDRVTISCRASQDISKYLNW YQQKPDGTVKLLIYHTSRLHSGVPSRFSGSGSGTD YSLTISNLEQEDIATYFCQQGNTLPYTFGGGTKLEI TGGGGSGGGGSGGGGSEVKLQESGPGLVAPSQSL SVTCTVSGVSLPDYGVSWIRQPPRKGLEWLGVIW GSETTYYNSALKSRLTIIKDNSKSQVFLKMNSLQT DDTAIYYCAKHYYYGGSYAMDYWGQGTSVTVS S | 418 | 5053, 5054-5058 |
| CD8α hinge--TM | TTTPAPRPPTPAPTIASQPLSLRPEACRPAAGGAVH TRGLDFACDIYIWAPLAGTCGVLLLSLVITLYC | 2746 | 5059, 5060, 5061-5063 |
| CD8α hinge | TTTPAPRPPTPAPTIASQPLSLRPEACRPAAGGAVH TRGLDFACD | 604 | 5064-5068 |
| CD3 zeta signaling domain | RVKFSRSADAPAYKQGQNQLYNELNLGRREEYD VLDKRRGRDPEMGGKPRRKNPQEGLYNELQKDK MAEAYSEIGMKGERRRGKGHDGLYQGLSTATKD TYDALHMQALPPR | 419 | 5069-5074 |
| 4-1BB (41BB) intracellular signaling domain | KRGRKKLLYIFKQPFMRPVQTTQEEDGCSCRFPEE EEGGCEL | 426 | 5075-5080 |
| CD8a Transmembrane domain | IYIWAPLAGTCGVLLLSLVITLYC | 562 | 5081-5082 |
| CD8α leader | MALPVTALLLPLALLLHAARP | 2747 | 5083-5087 |
| p40 signal sequence | MCHQQLVISWFSLVFLASPLVA | 2748 | 5088-5096 |
| p40 | IWELKKDVYVVELDWYPDAPGEMVVLTCDTPEE DGITWTLDQSSEVLGSGKTLTIQVKEFGDAGQYT CHKGGEVLSHSLLLLHKKEDGIWSTDILKDQKEP KNKTFLRCEAKNYSGRFTCWWLTTISTDLTFSVK SSRGSSDPQGVTCGAATLSAERVRGDNKEYEYSV ECQEDSACPAAEESLPIEVMVDAVHKLKYENYTS SFFIRDIIKPDPPKNLQLKPLKNSRQVEVSWEYPDT WSTPHSYFSLTFCVQVQGKSKREKKDRVFTDKTS ATVICRKNASISVRAQDRYYSSSWSEWASVPCS | 2749 | 5097-5109 |

TABLE 20-continued

Sequences of components of CD19 CARs

| Description | Amino Acid Sequence | Amino Acid SEQ ID NO | Nucleic Acid SEQ ID NO |
|---|---|---|---|
| p35 | RNLPVATPDPGMFPCLHHSQNLLRAVSNMLQKA RQTLEFYPCTSEEIDHEDITKDKTSTVEACLPLELT KNESCLNSRETSFITNGSCLASRKTSFMMALCLSSI YEDLKMYQVEFKTMNAKLLMDPKRQIFLDQNML AVIDELMQALNFNSETVPQKSSLEEPDFYKTKIKL CILLHAFRIRAVTIDRVMSYLNAS | 2750 | 5110-5120 |
| IL15 | NWVNVISDLKKIEDLIQSMHIDATLYTESDVHPSC KVTAMKCFLLELQVISLESGDASIHDTVENLIILAN NSLSSNGNVTESGCKECEELEEKNIKEFLQSFVHIV QMFINTS | 2751 | 5121-5125 |
| IL15Ra | ITCPPPMSVEHADIWVKSYSLYSRERYICNSGFKR KAGTSSLTECVLNKATNVAHWTTPSLKCIRDPAL VHQRPAPPSTVTTAGVTPQPESLSPSGKEPAASSPS SNNTAATTAAIVPGSQLMPSKSPSTGTTEISSHESS HGTPSQTTAKNWELTASASHQPPGVYPQGHSDTT VAISTSTVLLCGLSAVSLLACYLKSRQTPPLASVE MEAMEALPVTWGTSSRDEDLENCSHHL | 2752 | 5126-5128 |
| mCherry (M1L) | LSKGEEDNMAIIKEFMRFKVHMEGSVNGHEFEIE GEGEGRPYEGTQTAKLKVTKGGPLPFAWDILSPQ FMYGSKAYVKHPADIPDYLKLSFPEGFKWERVM NFEDGGVVTVTQDSSLQDGEFIYKVKLRGTNFPS DGPVMQKKTMGWEASSERMYPEDGALKGEIKQR LKLKDGGHYDAEVKTTYKAKKPVQLPGAYNVNI KLDITSHNEDYTIVEQYERAEGRHSTGGMDELYK | 2753 | 5129 |
| IRES | — | — | 5130 |
| Linker (GGSGG) | GGSGG | 2754 | 5131-5135 |
| Linker (SG) | SG | — | AGTGGA |
| Linker ((G4S)3) | GGGGSGGGGSGGGGS | 2755 | 5136-5141 |
| Linker (GGSG) | GGSG | 2756 | 5142 |
| Linker | MLLLVTSLLLCELPHPAFLLIP | 2757 | 5143 |
| Linker (SG3-(SG4)3-SG3-SLQ) | SGGGSGGGGSGGGGSGGGGSGGGSLQ | 2758 | 5144-5150 |
| Modified Furin | ESRRVRRNKRSK | 2759 | 5151-5153 |
| BamHI | — | — | GGATCC |
| Spacer | — | — | 2760 |
| HA Tag | YPYDVPDYA | 3080 | 5154-5156 |
| FKBP(F36V, L106P) | GVQVETISPGDGRTFPKRGQTCVVHYTGMLEDGK KVDSSRDRNKPFKFMLGKQEVIRGWEEGVAQMS VGQRAKLTISPDYAYGATGHPGIIPPHATLVFDVE LLKPE | 1176 | 5157-5161 |
| FKBP(E31G, F36V, R71G, K105E) | GVQVETISPGDGRTFPKRGQTCVVHYTGMLGDG KKVDSSRDRNKPFKFMLGKQEVIRGWEEGVAQM SVGQGAKLTISPDYAYGATGHPGIIPPHATLVFDV ELLELE | 1177 | 5162-5167 |
| ecDHFR (Amino acid 2-159 of WT)(R12Y, Y100I) | ISLIAALAVDYVIGMENAMPWNLPADLAWFKRN TLNKPVIMGRHTWESIGRPLPGRKNIILSSQPGTDD RVTWVKSVDEAIAACGDVPEIMVIGGGRVIEQFLP KAQKLYLTHIDAEVEGDTHFPDYEPDDWESVFSE FHDADAQNSHSYCFEILERR | 1174 | 5168-5173 |
| ecDHFR (Amino acid 2-159 of WT)(R12H, E129K) | ISLIAALAVDHVIGMENAMPWNLPADLAWFKRN TLNKPVIMGRHTWESIGRPLPGRKNIILSSQPGTDD RVTWVKSVDEAIAACGDVPEIMVIGGGRVYEQFL PKAQKLYLTHIDAEVEGDTHFPDYKPDDWESVFS EFHDADAQNSHSYCFEILERR | 1175 | 5174-5176 |

TABLE 20-continued

Sequences of components of CD19 CARs

| Description | Amino Acid Sequence | Amino Acid SEQ ID NO | Nucleic Acid SEQ ID NO |
|---|---|---|---|
| hDHFR (Amino acid 2-187 of WT; Y122I) | VGSLNCIVAVSQNMGIGKNGDLPWPPLRNEFRYF QRMTTTSSVEGKQNLVIMGKKTWFSIPEKNRPLK GRINLVLSRELKEPPQGAHFLSRSLDDALKLTEQP ELANKVDMVWIVGGSSVIKEAMNHPGHLKLFVT RIMQDFESDTFFPEIDLEKYKLLPEYPGVLSDVQE EKGIKYKFEVYEKND | 1257 | 5177-5178 |
| hDHFR (Amino acid 2-187 of WT; Y122I, A125F) | VGSLNCIVAVSQNMGIGKNGDLPWPPLRNEFRYF QRMTTTSSVEGKQNLVIMGKKTWFSIPEKNRPLK GRINLVLSRELKEPPQGAHFLSRSLDDALKLTEQP ELANKVDMVWIVGGSSVIKEFMNHPGHLKLFVT RIMQDFESDTFFPEIDLEKYKLLPEYPGVLSDVQE EKGIKYKFEVYEKND | 1252 | 5179-5182 |
| hDHFR (Amino acid 2-187 of WT; Q36K, Y122I) | VGSLNCIVAVSQNMGIGKNGDLPWPPLRNEFRYF KRMTTTSSVEGKQNLVIMGKKTWFSIPEKNRPLK GRINLVLSRELKEPPQGAHFLSRSLDDALKLTEQP ELANKVDMVWIVGGSSVIKEAMNHPGHLKLFVT RIMQDFESDTFFPEIDLEKYKLLPEYPGVLSDVQE EKGIKYKFEVYEKND | 1259 | 5183-5184 |
| hDHFR (Q36F, N65F, Y122I) | VGSLNCIVAVSQNMGIGKNGDLPWPPLRNEFRYF FRMTTTSSVEGKQNLVIMGKKTWFSIPEKFRPLKG RINLVLSRELKEPPQGAHFLSRSLDDALKLTEQPE LANKVDMVWIVGGSSVIKEAMNHPGHLKLFVTRI MQDFESDTFFPEIDLEKYKLLPEYPGVLSDVQEEK GIKYKFEVYEKND | 1253 | 5185-5188 |

TABLE 21

Sequences of CD19 CARs

| Description | Amino Acid Sequence | Amino Acid SEQ ID NO | Nucleic Acid SEQ ID NO |
|---|---|---|---|
| OT-CD19 CAR-001 (OT-CD19c-001)(CD8a leader -CD19 scFV-CD8a-Tm -41BB - CD3zeta - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDPACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPR* | 669 | 5190 |
| OT-CD19 CAR-002 (OT-CD19c-002)(CD8a leader - CD19 scFV-FKBP(F36V, L106P) - CD8a-Tm - 41BB - CD3zeta - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSGVQVETISPGDG RTFPKRGQTCVVHYTGMLEDGKKVDSSRDRNKP FKFMLGKQEVIRGWEEGVAQMSVGQRAKLTISPD YAYGATGHPGIIPPHATLVFDVELLKPETTTPAPRP PTPAPTIASQPLSLRPEACRPAAGGAVHTRGLDFA CDIYIWAPLAGTCGVLLLSLVITLYCKRGRKKLLY IFKQPFMRPVQTTQEEDGCSCRFPEEEEGGCELRV KFSRSADAPAYKQGQNQLYNELNLGRREEYDVL DKRRGRDPEMGGKPRRKNPQEGLYNELQKDKM AEAYSEIGMKGERRRGKGHDGLYQGLSTATKDT YDALHMQALPPR* | 670 | 5191 |

TABLE 21-continued

Sequences of CD19 CARs

| Description | Amino Acid Sequence | Amino Acid SEQ ID NO | Nucleic Acid SEQ ID NO |
|---|---|---|---|
| OT-CD19 CAR-003 (OT-CD19c-003)(CD8a leader - CD19 scFV-ecDHFR - CD8a-Tm - 41BB - CD3zeta - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSISLIAALAVDYVI GMENAMPWNLPADLAWFKRNTLNKPVIMGRHT WESIGRPLPGRKNIILSSQPGTDDRVTWVKSVDEA IAACGDVPEIMVIGGGRVIEQFLPKAQKLYLTHID AEVEGDTHFPDYEPDDWESVFSEFHDADAQNSHS YCFEILERRTTTPAPRPPTPAPTIASQPLSLRPEACR PAAGGAVHTRGLDFACDIYIWAPLAGTCGVLLLS LVITLYCKRGRKKLLYIFKQPFMRPVQTTQEEDGC SCRFPEEEEGGCELRVKFSRSADAPAYKQGQNQL YNELNLGRREEYDVLDKRRGRDPEMGGKPRRKN PQEGLYNELQKDKMAEAYSEIGMKGERRRGKGH DGLYQGLSTATKDTYDALHMQALPPR* | 671 | 5192 |
| OT-CD19 CAR-004 (OT-CD19c-004)(CD8a leader - CD19 scFV-CD8a Hinge - FKBP (F36V, L106P) -CD8a Transmembrane domain- 41BB - CD3zeta - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDGV QVETISPDGRTFPKRGQTCVVHYTGMLEDGKKV DSSRDRNKPFKFMLGKQEVIRGWEEGVAQMSVG QRAKLTISPDYAYGATGHPGIIPPHATLVFDVELL KPEIYIWAPLAGTCGVLLLSLVITLYCKRGRKKLL YIFKQPFMRPVQTTQEEDGCSCRFPEEEEGGCELR VKFSRSADAPAYKQGQNQLYNELNLGRREEYDV LDKRRGRDPEMGGKPRRKNPQEGLYNELQKDKM AEAYSEIGMKGERRRGKGHDGLYQGLSTATKDT YDALHMQALPPR* | 672 | 5193 |
| OT-CD19 CAR-005 (OT-CD19c-005)(CD8a leader - CD19 scFV-CD8a Hinge - ecDHFR (Amino acid 2-159 of WT)(R12Y, Y100I) - CD8a Transmembrane domain -41BB -CD3zeta - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDISLI AALAVDYVIGMENAMPWNLPADLAWFKRNTLN KPVIMGRHTWESIGRPLPGRKNIILSSQPGTDDRV TWVKSVDEAIAACGDVPEIMVIGGGRVIEQFLPK AQKLYLTHIDAEVEGDTHFPDYEPDDWESVFSEF HDADAQNSHSYCFEILERRIYIWAPLAGTCGVLLL SLVITLYCKRGRKKLLYIFKQPFMRPVQTTQEEDG CSCRFPEEEEGGCELRVKFSRSADAPAYKQGQNQ LYNELNLGRREEYDVLDKRRGRDPEMGGKPRRK NPQEGLYNELQKDKMAEAYSEIGMKGERRRGKG HDGLYQGLSTATKDTYDALHMQALPPR* | 673 | 5194 |
| OT-CD19c-006 (CD8a leader-CD19 scFV-CD8a-Tm - 41BB - CD3zeta -linker (GGSGG (SEQ ID NO: 2729)) - ecDHFR (Amino acid 2-159 of WT)(R12H, E129K) - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGGSGGISLIAALAVDHVIGMENAMPWNL | 674 | 5195 |

TABLE 21-continued

Sequences of CD19 CARs

| Description | Amino Acid Sequence | Amino Acid SEQ ID NO | Nucleic Acid SEQ ID NO |
|---|---|---|---|
| | PADLAWFKRNTLNKPVIMGRHTWESIGRPLPGRK NIILSSQPGTDDRVTWVKSVDEAIAACGDVPEIMV IGGGRVYEQFLPKAQKLYLTHIDAEVEGDTHFPD YKPDDWESVFSEFHDADAQNSHSYCFEILERR* | | |
| OT-CD19c-007 (CD8a leader - CD19 scFV- CD8a-Tm - 41BB - CD3zeta - linker (GGSGG(SEQ ID NO: 2729)) -FKBP (E31G, F36V, R71G, K105E) - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGGSGGGVQVETISPGDGRTFPKRGQTCV VHYTGMLGDGKKVDSSRDRNKPFKFMLGKQEVI RGWEEGVAQMSVGQGAKLTISPDYAYGATGHPG IIPPHATLVFDVELLELE* | 675 | 5196 |
| OT-CD19c-008 (CD8a leader - CD19 scFV- CD8a-Tm -41BB - CD3zeta - linker (GGSGG(SEQ ID NO: 2729)) - hDHFR (Amino acid 2-187 of WT; Y122I) - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGGSGGVGSLNCIVAVSQNMGIGKNGDLP WPPLRNEFRYFQRMTTTSSVEGKQNLVIMGKKT WFSIPEKNRPLKGRINLVLSRELKEPPQGAHFLSRS LDDALKLTEQPELANKVDMVWIVGGSSVIKEAM NHPGHLKLFVTRIMQDFESDTFFPEIDLEKYKLLP EYPGVLSDVQEEKGIKYKFEVYEKND* | 676 | 5197 |
| OT-CD19c-009 (CD8a leader - CD19 scFV- CD8a-Tm - 41BB - CD3zeta -linker (GGSGG (SEQ ID NO: 2729)) - hDHFR (Amino acid 2- 187 of WT; Y122I, A125F) - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGGSGGVGSLNCIVAVSQNMGIGKNGDLP WPPLRNEFRYFQRMTTTSSVEGKQNLVIMGKKT WFSIPEKNRPLKGRINLVLSRELKEPPQGAHFLSRS LDDALKLTEQPELANKVDMVWIVGGSSVIKEFM NHPGHLKLFVTRIMQDFESDTFFPEIDLEKYKLLP EYPGVLSDVQEEKGIKYKFEVYEKND* | 677 | 5198 |

TABLE 21-continued

Sequences of CD19 CARs

| Description | Amino Acid Sequence | Amino Acid SEQ ID NO | Nucleic Acid SEQ ID NO |
|---|---|---|---|
| OT-CD19c-010 (CD8a leader - CD19 scFV-CD8a-Tm - 41BB - CD3zeta - linker (GGSGG(SEQ ID NO: 2729)) -hDHFR (Amino acid 2-187 of WT; Q36K, Y122I) - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGGSGGVGSLNCIVAVSQNMGIGKNGDLP WPPLRNEFRYFKRMTTTSSVEGKQNLVIMGKKT WFSIPEKNRPLKGRINLVLSRELKEPPQGAHFLSRS LDDALKLTEQPELANKVDMVWIVGGSSVIKEAM NHPGHLKLFVTRIMQDFESDTFFPEIDLEKYKLLP EYPGVLSDVQEEKGIKYKFEVYEKND* | 678 | 5199 |
| OT-CD19c-011 (CD8a leader -CD19 scFV-CD8a-Tm - 41BB - CD3zeta -linker (GGSGG (SEQ ID NO: 2729)) - hDHFR (Amino acid 2-187 of WT; Q36K, N65F, Y122I) -stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGGSGGVGSLNCIVAVSQNMGIGKNGDLP WPPLRNEFRYFFRMTTTSSVEGKQNLVIMGKKTW FSIPEKFRPLKGRINLVLSRELKEPPQGAHFLSRSL DDALKLTEQPELANKVDMVWIVGGSSVIKEAMN HPGHLKLFVTRIMQDFESDTFFPEIDLEKYKLLPE YPGVLSDVQEEKGIKYKFEVYEKND* | 679 | 5200 |
| OT-CD19n-012 (CD8a leader - Linker (SG)- FKBP(F36V, L106P) - Furin Site -CD19 scFV-CD8a-Tm - 41BB - CD3zeta - stop) | MALPVTALLLPLALLLHAARPSGGVQVETISPGD GRTFPKRGQTCVVHYTGMLEDGKKVDSSRDRNK PFKFMLGKQEVIRGWEEGVAQMSVGQRAKLTISP DYAYGATGHPGIIPPHATLVFDVELLKPEESRRVR RNKRSKDIQMTQTTSSLSASLGDRVTISCRASQDIS KYLNWYQQKPDGTVKLLIYHTSRLHSGVPSRFSG SGSGTDYSLTISNLEQEDIATYFCQQGNTLPYTFG GGTKLEITGGGGSGGGGSGGGGSEVKLQESGPGL VAPSQSLSVTCTVSGVSLPDYGVSWIRQPPRKGLE WLGVIWGSETTYYNSALKSRLTIIKDNSKSQVFLK MNSLQTDDTAIYYCAKHYYYGGSYAMDYWGQG TSVTVSSTTTPAPRPPTPAPTIASQPLSLRPEACRPA AGGAVHTRGLDFACDIYIWAPLAGTCGVLLLSLV ITLYCKRGRKKLLYIFKQPFMRPVQTTQEEDGCSC RFPEEEEGGCELRVKFSRSADAPAYKQGQNQLYN ELNLGRREEYDVLDKRRGRDPEMGGKPRRKNPQ EGLYNELQKDKMAEAYSEIGMKGERRRGKGHDG LYQGLSTATKDTYDALHMQALPPR* | 680 | 5201 |
| OT-CD19n-013 (CD8a leader - Linker (SG)- ecDHFR (Amino acid 2- 159 of WT)(R12Y, Y100I) - Furin Site - CD19 scFV-CD8a-Tm - 41BB - CD3zeta - stop) | MALPVTALLLPLALLLHAARPSGISLIAALAVDYV IGMENAMPWNLPADLAWFKRNTLNKPVIMGRHT WESIGRPLPGRKNIILSSQPGTDDRVTWVKSVDEA IAACGDVPEIMVIGGGRVIEQFLPKAQKLYLTHID AEVEGDTHFPDYEPDDWESVFSEFHDADAQNSHS YCFEILERRESRRVRRNKRSKDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY | 681 | 5202 |

TABLE 21-continued

Sequences of CD19 CARs

| Description | Amino Acid Sequence | Amino Acid SEQ ID NO | Nucleic Acid SEQ ID NO |
|---|---|---|---|
| | YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPR* | | |
| OT-CD19n-014 (CD8a leader - Linker (SG)- hDHFR (Amino acid 2- 187 of WT; Y122I, A125F) - Furin Site - CD19 scFV- CD8a-Tm - 41BB -CD3zeta - stop) | MALPVTALLLPLALLLHAARPSGVGSLNCIVAVS QNMGIGKNGDLPWPPLRNEFRYFQRMTTTSSVEG KQNLVIMGKKTWFSIPEKNRPLKGRINLVLSRELK EPPQGAHFLSRSLDDALKLTEQPELANKVDMVWI VGGSSVIKEFMNHPGHLKLFVTRIMQDFESDTFFP EIDLEKYKLLPEYPGVLSDVQEEKGIKYKFEVYEK NDESRRVRRNKRSKDIQMTQTTSSLSASLGDRVTI SCRASQDISKYLNWYQQKPDGTVKLLIYHTSRLH SGVPSRFSGSGSGTDYSLTISNLEQEDIATYFCQQG NTLPYTFGGGTKLEITGGGGSGGGGSGGGGSEVK LQESGPGLVAPSQSLSVTCTVSGVSLPDYGVSWIR QPPRKGLEWLGVIWGSETTYYNSALKSRLTIIKDN SKSQVFLKMNSLQTDDTAIYYCAKHYYYGGSYA MDYWGQGTSVTVSSTTTPAPRPPTPAPTIASQPLS LRPEACRPAAGGAVHTRGLDFACDIYIWAPLAGT CGVLLLSLVITLYCKRGRKKLLYIFKQPFMRPVQT TQEEDGCSCRFPEEEEGGCELRVKFSRSADAPAY KQGQNQLYNELNLGRREEYDVLDKRRGRDPEMG GKPRRKNPQEGLYNELQKDKMAEAYSEIGMKGE RRRGKGHDGLYQGLSTATKDTYDALHMQALPPR * | 682 | 5203 |
| OT-CD19n-015 (CD8a leader - Linker (SG)- hDHFR (Amino acid 2- 187 of WT; Q36K, Y122I) -Furin Site - CD19 scFV- CD8a-Tm - 41BB - CD3zeta -stop) | MALPVTALLLPLALLLHAARPSGVGSLNCIVAVS QNMGIGKNGDLPWPPLRNEFRYFKRMTTTSSVEG KQNLVIMGKKTWFSIPEKNRPLKGRINLVLSRELK EPPQGAHFLSRSLDDALKLTEQPELANKVDMVWI VGGSSVIKEAMNHPGHLKLFVTRIMQDFESDTFFP EIDLEKYKLLPEYPGVLSDVQEEKGIKYKFEVYEK NDESRRVRRNKRSKDIQMTQTTSSLSASLGDRVTI SCRASQDISKYLNWYQQKPDGTVKLLIYHTSRLH SGVPSRFSGSGSGTDYSLTISNLEQEDIATYFCQQG NTLPYTFGGGTKLEITGGGGSGGGGSGGGGSEVK LQESGPGLVAPSQSLSVTCTVSGVSLPDYGVSWIR QPPRKGLEWLGVIWGSETTYYNSALKSRLTIIKDN SKSQVFLKMNSLQTDDTAIYYCAKHYYYGGSYA MDYWGQGTSVTVSSTTTPAPRPPTPAPTIASQPLS LRPEACRPAAGGAVHTRGLDFACDIYIWAPLAGT CGVLLLSLVITLYCKRGRKKLLYIFKQPFMRPVQT TQEEDGCSCRFPEEEEGGCELRVKFSRSADAPAY KQGQNQLYNELNLGRREEYDVLDKRRGRDPEMG GKPRRKNPQEGLYNELQKDKMAEAYSEIGMKGE RRRGKGHDGLYQGLSTATKDTYDALHMQALPPR * | 683 | 5204 |
| OT-CD19-056 (CD8a leader - CD19 scFV- CD8a-Tm - 41BB - CD3zeta - linker (GGSGG(SEQ ID NO: 2729)) - hDHFR (Amino acid 2-187 of WT; Y122I) - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGS GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGGSGGVGSLNCIVAVSQNMGIGKNGDLP WPPLRNEFRYFQRMTTTSSVEGKQNLVIMGKKT WFSIPEKNRPLKGRINLVLSRELKEPPQGAHFLSRS LDDALKLTEQPELANKVDMVWIVGGSSVIKEAM NHPGHLKLFVTRIMQDFESDTFFPEIDLEKYKLLP EYPGVLSDVQEEKGIKYKFEVYEKND* | 684 | 5205 |

TABLE 21-continued

Sequences of CD19 CARs

| Description | Amino Acid Sequence | Amino Acid SEQ ID NO | Nucleic Acid SEQ ID NO |
|---|---|---|---|
| OT-CD19-057 (CD8a leader -CD19 scFV- CD8a-Tm - 41BB - CD3zeta - BamHI(GS)- stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGS* | 685 | 5206 |
| OT-CD19-058 (CD8a leader -CD19 scFV- CD8a-Tm - 41BB - CD3zeta - p2A - BamHI (GS)- stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGATNFSLLKQAGDVEENPGPGS* | 686 | 5207 |
| OT-CD19-059 (CD8a leader - HA Tag - CD19 scFV- CD8a-Tm - 41BB - CD3zeta - BamHI(GS)- stop) | MALPVTALLLPLALLLHAARPYPYDVPDYADIQM TQTTSSLSASLGDRVTISCRASQDISKYLNWYQQK PDGTVKLLIYHTSRLHSGVPSRFSGSGSGTDYSLTI SNLEQEDIATYFCQQGNTLPYTFGGGTKLEITGGG GSGGGGSGGGGSEVKLQESGPGLVAPSQSLSVTC TVSGVSLPDYGVSWIRQPPRKGLEWLGVIWGSET TYYNSALKSRLTIIKDNSKSQVFLKMNSLQTDDTA IYYCAKHYYYGGSYAMDYWGQGTSVTVSSTTTP APRPPTPAPTIASQPLSLRPEACRPAAGGAVHTRG LDFACDIYIWAPLAGTCGVLLLSLVITLYCKRGRK KLLYIFKQPFMRPVQTTQEEDGCSCRFPEEEEGGC ELRVKFSRSADAPAYKQGQNQLYNELNLGRREE YDVLDKRRGRDPEMGGKPRRKNPQEGLYNELQK DKMAEAYSEIGMKGERRRGKGHDGLYQGLSTAT KDTYDALHMQALPPRGS* | 687 | 5208 |
| OT-CD19-060 (CD8a leader - CD19 scFV- CD8a-Tm- 41BB - CD3zeta - Linker (SG)- Furin - BamHI(GS)- stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRSGESRRVRRNKRSKGS* | 688 | 5209 |
| OT-CD19-063 (CD8a leader - CD19 scFV- CD8a-Tm - 41BB - CD3zeta - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP | 689 | 5210 |

TABLE 21-continued

Sequences of CD19 CARs

| Description | Amino Acid Sequence | Amino Acid SEQ ID NO | Nucleic Acid SEQ ID NO |
|---|---|---|---|
| | FMRPVQTTQEEDGCSCRFPEEEEGGCELRVKFSRS<br>ADAPAYKQGQNQLYNELNLGRREEYDVLDKRRG<br>RDPEMGGKPRRKNPQEGLYNELQKDKMAEAYSE<br>IGMKGERRRGKHDGLYQGLSTATKDTYDALHM<br>QALPPR* | | |
| OT-CD19-064 (CD8a leader - CD19 scFV- CD8a-Tm - 41BB - CD3zeta - Linker (TR)- HA Tag - FKBP (E31G, F36V, R71G, K105E) - stop-IRES- mCherry) | MALPVTALLLPLALLLHAARPDIQMTQTTSSLSAS<br>LGDRVTISCRASQDISKYLNWYQQKPDGTVKLLI<br>YHTSRLHSGVPSRFSGSGSGTDYSLTISNLEQEDIA<br>TYFCQQGNTLPYTFGGGTKLEITGGGGSGGGGSG<br>GGGSEVKLQESGPGLVAPSQSLSVTCTVSGVSLPD<br>YGVSWIRQPPRKGLEWLGVIWGSETTYYNSALKS<br>RLTIIKDNSKSQVFLKMNSLQTDDTAIYYCAKHY<br>YYGGSYAMDYWGQGTSVTVSSTTTPAPRPPTPAP<br>TIASQPLSLRPEACRPAAGGAVHTRGLDFACDIYI<br>WAPLAGTCGVLLLSLVITLYCKRGRKKLLYIFKQP<br>FMRPVQTTQEEDGCSCRFPEEEEGGCELRVKFSRS<br>ADAPAYKQGQNQLYNELNLGRREEYDVLDKRRG<br>RDPEMGGKPRRKNPQEGLYNELQKDKMAEAYSE<br>IGMKGERRRGKHDGLYQGLSTATKDTYDALHM<br>QALPPRTRYPYDVPDYAGVQVETISPGDGRTFPK<br>RGQTCVVHYTGMLGDGKKVDSSRDRNKPFKFML<br>GKQEVIRGWEEGVAQMSVGQGAKLTISPDYAYG<br>ATGHPGIIPPHATLVFDVELLELE*MHRSAAAAT*I<br>PPPPPLSLPPP*RYWPKPLGIRPVCVCLYVIFHHIAV<br>FWQCEGPETWPCLLDEHS*GSFPSRQRNARSVEC<br>REGSSSSGSFLKTNNVCSDPLQAAEPPTWRQVPLR<br>PKATCIRYTCKGGTTPVPRCELDSCGKSQMALLK<br>RIQQGAEGCPEGTPLYGI*SGASVHMLYMCLVEV<br>KKTSRPPEPRGRGFPLKNTMIIWPQP**ARARRIT<br>WPSSRSSCASRCTWRAP*TATSSRSRARARAAPTR<br>APRPPS*R*PRVAPCPSPGTSCPLSSCTAPRPT*STP<br>PTSPTT*SCPSPRASSGSA**TSRTAAW*P*PRTPPC<br>RTASSSTR*SCAAPTSPPTAP*CRRRPWAGRPPPSG<br>CTPRTAP*RARSSRG*S*RTAATTTLRSRPPTRPRS<br>PCSCPAPTTSTSSWTSPPTTRTTPSWNSTNAPRAA<br>TPPAAWTSCTS* | 694-710 | 5211 |
| OT-CD19-066 (CD8a leader - CD19 scFV- CD8a-Tm - 41BB - CD3zeta - Linker (GS)- P2A peptide -mCherry (M1L) - stop) | MALPVTALLLPLALLLHAARPDIQMTQTTSSLSAS<br>LGDRVTISCRASQDISKYLNWYQQKPDGTVKLLI<br>YHTSRLHSGVPSRFSGSGSGTDYSLTISNLEQEDIA<br>TYFCQQGNTLPYTFGGGTKLEITGGGGSGGGGSG<br>GGGSEVKLQESGPGLVAPSQSLSVTCTVSGVSLPD<br>YGVSWIRQPPRKGLEWLGVIWGSETTYYNSALKS<br>RLTIIKDNSKSQVFLKMNSLQTDDTAIYYCAKHY<br>YYGGSYAMDYWGQGTSVTVSSTTTPAPRPPTPAP<br>TIASQPLSLRPEACRPAAGGAVHTRGLDFACDIYI<br>WAPLAGTCGVLLLSLVITLYCKRGRKKLLYIFKQP<br>FMRPVQTTQEEDGCSCRFPEEEEGGCELRVKFSRS<br>ADAPAYKQGQNQLYNELNLGRREEYDVLDKRRG<br>RDPEMGGKPRRKNPQEGLYNELQKDKMAEAYSE<br>IGMKGERRRGKHDGLYQGLSTATKDTYDALHM<br>QALPPRGSGATNFSLLKQAGDVEENPGPLSKGEE<br>DNMAIIKEFMRFKVHMEGSVNGHEFEIEGEGEGR<br>PYEGTQTAKLKVTKGGPLPFAWDILSPQFMYGSK<br>AYVKHPADIPDYLKLSFPEGFKWERVMNFEDGG<br>VVTVTQDSSLQDGEFIYKVKLRGTNFPSDGPVMQ<br>KKTMGWEASSERMYPEDGALKGEIKQRLKLKDG<br>GHYDAEVKTTYKAKKPVQLPGAYNVNIKLDITSH<br>NEDYTIVEQYERAEGRHSTGGMDELYK* | 690 | 5212 |
| OT-CAR19-IL15-001 (CD8a leader - CD19 scFV-CD8a-Tm - 41BB - CD3zeta - Linker (GS) - P2A - IL15 -Linker (SG3-(SG4)3-SG3 -SLQ (SEQ ID NO: 2730)) - IL15Ra - stop) | MALPVTALLLPLALLLHAARPDIQMTQTTSSLSAS<br>LGDRVTISCRASQDISKYLNWYQQKPDGTVKLLI<br>YHTSRLHSGVPSRFSGSGSGTDYSLTISNLEQEDIA<br>TYFCQQGNTLPYTFGGGTKLEITGGGGSGGGGSG<br>GGGSEVKLQESGPGLVAPSQSLSVTCTVSGVSLPD<br>YGVSWIRQPPRKGLEWLGVIWGSETTYYNSALKS<br>RLTIIKDNSKSQVFLKMNSLQTDDTAIYYCAKHY<br>YYGGSYAMDYWGQGTSVTVSSTTTPAPRPPTPAP<br>TIASQPLSLRPEACRPAAGGAVHTRGLDFACDIYI<br>WAPLAGTCGVLLLSLVITLYCKRGRKKLLYIFKQP<br>FMRPVQTTQEEDGCSCRFPEEEEGGCELRVKFSRS<br>ADAPAYKQGQNQLYNELNLGRREEYDVLDKRRG<br>RDPEMGGKPRRKNPQEGLYNELQKDKMAEAYSE | 691 | 5213 |

TABLE 21-continued

Sequences of CD19 CARs

| Description | Amino Acid Sequence | Amino Acid SEQ ID NO | Nucleic Acid SEQ ID NO |
|---|---|---|---|
| | IGMKGERRRGKGHDGLYQGLSTATKDTYDALHM QALPPRGSGATNFSLLKQAGDVEENPGPNWVNVI SDLKKIEDLIQSMHIDATLYTESDVHPSCKVTAMK CFLLELQVISLESGDASIHDTVENLIILANNSLSSNG NVTESGCKECEELEEKNIKEFLQSFVHIVQMFINTS SGGGSGGGGSGGGGSGGGGSGGGSLQITCPPPMS VEHADIWVKSYSLYSRERYICNSGFKRKAGTSSLT ECVLNKATNVAHWTTPSLKCIRDPALVHQRPAPP STVTTAGVTPQPESLSPSGKEPAASSPSSNNTAATT AAIVPGSQLMPSKSPSTGTTEISSHESSHGTPSQTT AKNWELTASASHQPPGVYPQGHSDTTVAISTSTV LLCGLSAVSLLACYLKSRQTPPLASVEMEAMEAL PVTWGTSSRDEDLENCSHHL* | | |
| OT-CAR19-IL15-002 (CD8a leader -CD19 scFV-CD8a-Tm -41BB - CD3zeta - Linker (GS)- P2A - Linker (MLLLVTSLLLCELPHP AFLLIP)(SEQ ID NO: 2743) - IL15 - Linker (SG3-(SG4)3-SG3-SLQ (SEQ ID NO: 2730)) - IL15Ra - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGSGATNFSLLKQAGDVEENPGPMLLLVT SLLLCELPHPAFLLIPNWVNVISDLKKIEDLIQSMH IDATLYTESDVHPSCKVTAMKCFLLELQVISLESG DASIHDTVENLIILANNSLSSNGNVTESGCKECEEL EEKNIKEFLQSFVHIVQMFINTSSGGGSGGGGSGG GGSGGGGSGGGSLQITCPPPMSVEHADIWVKSYS LYSRERYICNSGFKRKAGTSSLTECVLNKATNVA HWTTPSLKCIRDPALVHQRPAPPSTVTTAGVTPQP ESLSPSGKEPAASSPSSNNTAATTAAIVPGSQLMPS KSPSTGTTEISSHESSHGTPSQTTAKNWELTASAS HQPPGVYPQGHSDTTVAISTSTVLLCGLSAVSLLA CYLKSRQTPPLASVEMEAMEALPVTWGTSSRDED LENCSHHL* | 692 | 5214 |
| OT-CD19-IL15-006 (CD8a leader -CD19 scFV- CD8a-Tm - 41BB - CD3zeta - Linker (GS)- P2A - IgE Leader - IL15 - Linker (SG3 -(SG4)3- SG3-SLQ (SEQ ID NO: 2730)) - IL15Ra - stop) | MALPVTALLLPLALLLHAARPDIQMTQTTSSLSAS LGDRVTISCRASQDISKYLNWYQQKPDGTVKLLI YHTSRLHSGVPSRFSGSGSGTDYSLTISNLEQEDIA TYFCQQGNTLPYTFGGGTKLEITGGGGSGGGGSG GGGSEVKLQESGPGLVAPSQSLSVTCTVSGVSLPD YGVSWIRQPPRKGLEWLGVIWGSETTYYNSALKS RLTIIKDNSKSQVFLKMNSLQTDDTAIYYCAKHY YYGGSYAMDYWGQGTSVTVSSTTTPAPRPPTPAP TIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRGSGATNFSLLKQAGDVEENPGPMDWTW ILFLVAAATRVHSNWVNVISDLKKIEDLIQSMHID ATLYTESDVHPSCKVTAMKCFLLELQVISLESGDA SIHDTVENLIILANNSLSSNGNVTESGCKECEELEE KNIKEFLQSFVHIVQMFINTSSGGGSGGGGSGGGG SGGGGSGGGSLQITCPPPMSVEHADIWVKSYSLYS RERYICNSGFKRKAGTSSLTECVLNKATNVAHWT TPSLKCIRDPALVHQRPAPPSTVTTAGVTPQPESLS PSGKEPAASSPSSNNTAATTAAIVPGSQLMPSKSPS TGTTEISSHESSHGTPSQTTAKNWELTASASHQPP GVYPQGHSDTTVAISTSTVLLCGLSAVSLLACYLK SRQTPPLASVEMEAMEALPVTWGTSSRDEDLENC SHHL* | 693 | 5215 |

Constructs disclosed in Table 20 which are transcriptionally controlled by a CMV promoter, in some instances may be placed under the transcriptional control of a different promoter to test the role of promoters in CD19 CAR expression. In one embodiment, the CMV promoter may be replaced by an EF1a promoter. In one embodiment, the CMV promoter of the, OT-CD19-001 construct, may be replaced to generate OT-CD19N-017 construct, with a EF1a promoter. In another embodiment, the CMV promoter of the CD19 CAR, OT-CD19 CAR-002 construct, may be replaced to generate OT-CD19N-018 construct, with a EF1a promoter. In another embodiment, the CMV promoter of the CD19 CAR, OT-CD19 CAR-003 construct, may be replaced to generate OT-CD19N-019 construct, with a EF1a promoter. In another embodiment, the CMV promoter of the CD19 CAR, OT-CD19 CAR-004 construct, may be replaced to generate OT-CD19N-020 construct, with a EF1a promoter. In another embodiment, the CMV promoter of the CD19 CAR, OT-CD19 CAR-005 construct, may be replaced to generate OT-CD19N-021 construct, with a EF1a promoter. In another embodiment, the CMV promoter of the CD19 CAR, OT-CD19 CAR-006 construct, may be replaced to generate OT-CD19N-022 construct, with a EF1a promoter. In another embodiment, the CMV promoter of the CD19 CAR, OT-CD19 CAR-007 construct, may be replaced to generate OT-CD19N-023 construct, with a EF1a promoter. In another embodiment, the CMV promoter of the CD19 CAR, OT-CD19 CAR-008 construct, may be replaced to generate OT-CD19N-024 construct, with a EF1a promoter. In another embodiment, the CMV promoter of the CD19 CAR, OT-CD19 CAR-009 construct, may be replaced to generate OT-CD19N-025 construct, with a EF1a promoter.

In one embodiment, the CAR construct comprises a CD19 scFV (e.g., CAT13.1E10 or FMC63), a CD8a spacer or transmembrane domain, and a 4-1BB and CD3 endodomain. These constructs with CAT13.1E10 may have increased proliferation after stimulation in vitro, increased cytotoxicity against the CD19+ targets, and increased effector and target interactions as compared to constructs with FMC63.

In some embodiments, the payloads of the present invention may be tuned using the catalytic domains of the E3 ubiquitin ligases. The catalytic domains of E3 ligases may be fused to an antibody or a fragment of the antibody. The payload is fused to the antigen recognized by the antibody or a fragment of the antibody that is fused to the E3 ligases catalytic domain. The E3 ligases useful in the present invention include, but are not limited to Ring E3 ligase, HECT E3 ligases and RBR E3 ligases. Any of the methods taught by Kanner S A et al. (2017) eLife; 6: e29744 may be useful in the present invention (the contents of which are incorporated by reference in their entirety).

In some embodiments, the payloads described herein, may be regulated by E3 ubiquitin ligases constructs. The E3 ligases constructs may comprise the catalytic domain of E3 ligases fused to an SRE and an antibody or a fragment of an antibody. The payloads are fused to the antigen recognized by the antibody or a fragment of an antibody, that is appended to the catalytic domain of E3 ligases. In the absence of the stimulus corresponding to the SRE, the E3 ubiquitin ligases constructs are destabilized, which in turn, allows the expression of the payloads fused to the antigen. In the presence of ligand corresponding to the SRE, the E3 ubiquitin ligases constructs are stabilized and available to bind to the antigen fused to the payloads. Binding of the E3 ligases constructs to the antigens, targets the protein for degradation. The E3 ubiquitin ligases constructs may be used to regulate any payload described herein, provided the payload is fused to an antigen recognized by the antibody or the fragment of the antibody in the E3 ubiquitin ligases construct. In some embodiments, the payload is a chimeric antigen receptor. The E3 ubiquitin ligases constructs may be used to design logic gates. In one embodiment, the E3 ubiquitin ligases constructs may be used to generate a NOT gate, wherein one ligand induces the expression of the payload, while another inhibits the expression of the payload. In some embodiments, the NOT gate may be generated using the E3 ubiquitin ligases constructs and by fusing the payloads-antigen fusion protein to a second a SRE that is distinct from the SRE in the E3 ubiquitin ligase construct.

In some embodiments, the payload of the invention may be any of the co-stimulatory molecules and/or intracellular domains described herein. In some embodiments, one or more co-stimulatory molecules, each under the control of different SRE may be used in the present invention. SRE regulated co-stimulatory molecules may also be expressed in conjunction with a first generation CAR, a second generation CAR, a third generation CAR, a fourth generation, or any other CAR design described herein.

In one embodiment of the present invention, the payload of the invention is a CD33 specific CAR. The CD33 heavy and light chain may be combined with any of the signal peptides, transmembrane domains, costimulatory domains, intracellular domains and destabilizing domains described herein.

In one embodiment of the present invention, the payload of the invention is a GD2 specific CAR. The GD2 heavy and light chain may be combined with any of the signal peptides, transmembrane domains, costimulatory domains, intracellular domains and destabilizing domains described herein.

In one embodiment of the present invention, the payload of the invention is a Her2 specific CAR. The Her2 heavy and light chain may be combined with any of the signal peptides, transmembrane domains, costimulatory domains, intracellular domains and destabilizing domains described herein. Exemplary BCMA CAR sequences and its components are described in Table 21. The amino acid sequences in Table 21 may comprise a stop codon which is denoted in the table with a "*" at the end of the amino acid sequence

TABLE 21

DD-Her2 construct sequences

| Description | Amino Acid Sequence | Amino Acid SEQ ID NO | Nucleic Acid SEQ ID NO/ Sequence |
|---|---|---|---|
| GMCSF Leader | LLLVTSLLLCELPHPAFLLIP | 2762 | 5216 |
| Linker | ASFE | 2763 | 5217 |

TABLE 21-continued

DD-Her2 construct sequences

| Description | Amino Acid Sequence | Amino Acid SEQ ID NO | Nucleic Acid SEQ ID NO/ Sequence |
|---|---|---|---|
| Linker | GS | — | GGTTCC GGATCC |
| Linker | TS | — | ACTAGT |
| Linker | HM | — | ATGCAC |
| 4-1BB Intracellular Domain | KRGRKKLLYIFKQPFMRPVQTTQEEDGCSCRFPEEEEGG CEL | 2764 | 5218 |
| 4D5 scFV | DIQMTQSPSSLSASVGDRVTITCRASQDVNTAVAWYQQ KPGKAPKLLIYSASFLYSGVPSRFSGSRSGTDFTLTISSLQ PEDFATYYCQQHYTTPPTFGQGTKVEIKGSTSGSGKPGS GEGSGEVQLVESGGGLVQPGGSLRLSCAASGFNIKDTYI HWVRQAPGKGLEWVARIYPTNGYTRYADSVKGRFTISA DTSKNTAYLQMNSLRAEDTAVYYCSRWGGDGFYAMD VWGQGTLVTVSS | 5219 2765 | |
| CD8a Hinge | TTTPAPRPPTPAPTIASQPLSLRPEACRPAAGGAVHTRGL DFACD | 2767 | 5220 |
| Transmembrane Domain | IYIWAPLAGTCGVLLLSLVITLYC | 2768 | 5221 |
| CD3 Zeta signaling Domain | RVKFSRSADAPAYKQGQNQLYNELNLGRREEYDVLDK RRGRDPEMGGKPRRKNPQEGLYNELQKDKMAEAYSEI GMKGERRRGKGHDGLYQGLSTATKDTYDALHMQALPP R | 2769 | 5222 |
| hDHFR (Amino acid 2-187 of WT; Y122I) | VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVIKEAMNHPGHLKLFVTRIMQDFESDTFFPEIDLEK YKLLPEYPGVLSDVQEEKGIKYKFEVYEKND | 2770 | 5223-5226 |
| OT-Her2-004 (Met - GMCSF Leader - 4D5 scFv - Linker (ASFE (SEQ ID NO: 3092))- CD8a hinge - Linker (GS)- Transmembrane Domain - Linker (TS) - 4-1BB intracellular signaling domain - Linker (HM) - CD3 zeta - Linker (GS) - hDHFR (Amino acid 2-187 of WT; Y122I)- stop) | MLLLVTSLLLCELPHPAFLLIPDIQMTQSPSSLSASVGDR VTITCRASQDVNTAVAWYQQKPGKAPKLLIYSASFLYS GVPSRFSGSRSGTDFTLTISSLQPEDFATYYCQQHYTTPP TFGQGTKVEIKGSTSGSGKPGSGEGSGEVQLVESGGGLV QPGGSLRLSCAASGFNIKDTYIHWVRQAPGKGLEWVAR IYPTNGYTRYADSVKGRFTISADTSKNTAYLQMNSLRAE DTAVYYCSRWGGDGFYAMDVWGQGTLVTVSSASFETT TPAPRPPTPAPTIASQPLSLRPEACRPAAGGAVHTRGLDF ACDGSIYIWAPLAGTCGVLLLSLVITLYCTSKRGRKKLL YIFKQPFMRPVQTTQEEDGCSCRFPEEEEGGCELHMRVK FSRSADAPAYKQGQNQLYNELNLGRREEYDVLDKRRG RDPEMGGKPRRKNPQEGLYNELQKDKMAEAYSEIGMK GERRRGKGHDGLYQGLSTATKDTYDALHMQALPPRGS VGSLNCIVAVSQNMGIGKNGDLPWPPLRNEFRYFQRMT TTSSVEGKQNLVIMGKKTWFSIPEKNRPLKGRINLVLSR ELKEPPQGAHFLSRSLDDALKLTEQPELANKVDMVWIV GGSSVIKEAMNHPGHLKLFVTRIMQDFESDTFFPEIDLEK YKLLPEYPGVLSDVQEEKGIKYKFEVYEKND* | 1171 | 5227 |

In one embodiment, the CAR of the present invention is a BCMA (B-cell maturation antigen) CAR, also referred to as the CD269. The BCMA heavy and light chains may be combined with any of the signal peptides, transmembrane domains, costimulatory domains, intracellular domains and destabilizing domains described herein. Exemplary BCMA CAR sequences and its components are described in Table 22. The amino acid sequences in Table 22 may comprise a stop codon which is denoted in the table with a "*" at the end of the amino acid sequence.

TABLE 22

BCMA CAR

| Description | Amino Acid Sequence | Amino Acid SEQ ID NO. | Nucleic Acid SEQ ID NO. |
|---|---|---|---|
| BCMA scFv (C11D5.3) | DIVLTQSPASLAMSLGKRATISCRASESVSVIGAHL IHWYQQKPGQPPKLLIYLASNLETGVPARFSGSGS GTDFTLTIDPVEEDDVAIYSCLQSRIFPRTFGGGTK LEIKGSTSGSGKPGSGEGSTKGQIQLVQSGPELKK PGETVKISCKASGYTFTDYSINWVKRAPGKGLKW MGWINTETREPAYAYDFRGRFAFSLETSASTAYL QINNLKYEDTATYFCALDYSYAMDYWGQGTSVT VSS | 2772 | 5228 |
| CD8α hinge-TM | TTTPAPRPPTPAPTIASQPLSLRPEACRPAAGGAVH TRGLDFACDIYIWAPLAGTCGVLLLSLVITLYC | 2773 | 5229 |
| CD3 zeta signaling domain | RVKFSRSADAPAYKQGQNQLYNELNLGRREEYD VLDKRRGRDPEMGGKPRRKNPQEGLYNELQKDK MAEAYSEIGMKGERRRGKGHDGLYQGLSTATKD TYDALHMQALPPR | 2769 | 5230 |
| 4-1BB intracellular signaling domain | KRGRKKLLYIFKQPFMRPVQTTQEEDGCSCRFPEE EEGGCEL | 2764 | 5231 |
| CD8α leader | MALPVTALLLPLALLLHAARP | 2766 | 5232-5237 |
| ecDHFR (Amino acid 2-159 of WT)(R12Y, Y100I) | ISLIAALAVDYVIGMENAMPWNLPADLAWFKRN TLNKPVIMGRHTWESIGRPLPGRKNIILSSQPGTDD RVTWVKSVDEAIAACGDVPEIMVIGGGRVIEQFLP KAQKLYLTHIDAEVEGDTHFPDYEPDDWESVFSE FHDADAQNSHSYCFEILERR | 2774 | 5238-5244 |
| FKBP (E31G, F36V, R71G, K105E) | GVQVETISPGDGRTFPKRGQTCVVHYTGMLGDG KKVDSSRDRNKPFKFMLGKQEVIRGWEEGVAQM SVGQGAKLTISPDYAYGATGHPGIIPPHATLVFDV ELLELE | 2775 | 5245-5252 |
| OT-BCMA-001 (CD8a leader- BCMA scFv - CD8a hinge-Tm - 4-1BB intracellular domain - CD3 zeta - stop) | MALPVTALLLPLALLLHAARPDIVLTQSPASLAMS LGKRATISCRASESVSVIGAHLIHWYQQKPGQPPK LLIYLASNLETGVPARFSGSGSGTDFTLTIDPVEED DVAIYSCLQSRIFPRTFGGGTKLEIKGSTSGSGKPG SGEGSTKGQIQLVQSGPELKKPGETVKISCKASGY TFTDYSINWVKRAPGKGLKWMGWINTETREPAY AYDFRGRFAFSLETSASTAYLQINNLKYEDTATYF CALDYSYAMDYWGQGTSVTVSSTTTPAPRPPTPA PTIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPR* | 1168 | 5253 |
| OT-BCMA-002 (CD8a leader - BCMA scFv - CD8a hinge-Tm -4-1BB intracellular domain - CD3 zeta - Linker (SG) - FKBP(E31G, F36V, R71G, K105E) - stop) | MALPVTALLLPLALLLHAARPDIVLTQSPASLAMS LGKRATISCRASESVSVIGAHLIHWYQQKPGQPPK LLIYLASNLETGVPARFSGSGSGTDFTLTIDPVEED DVAIYSCLQSRIFPRTFGGGTKLEIKGSTSGSGKPG SGEGSTKGQIQLVQSGPELKKPGETVKISCKASGY TFTDYSINWVKRAPGKGLKWMGWINTETREPAY AYDFRGRFAFSLETSASTAYLQINNLKYEDTATYF CALDYSYAMDYWGQGTSVTVSSTTTPAPRPPTPA PTIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRSGGVQVETISPGDGRTFPKRGQTCVVHY TGMLGDGKKVDSSRDRNKPFKFMLGKQEVIRGW EEGVAQMSVGQGAKLTISPDYAYGATGHPGIIPPH ATLVFDVELLELE* | 1169 | 5254 |
| OT-BCMA-003 (CD8a leader - BCMA scFv - CD8a hinge-Tm - 4-1BB intracellular domain - CD3 zeta - Linker (SG) - ecDHFR (Amino acid 2- | MALPVTALLLPLALLLHAARPDIVLTQSPASLAMS LGKRATISCRASESVSVIGAHLIHWYQQKPGQPPK LLIYLASNLETGVPARFSGSGSGTDFTLTIDPVEED DVAIYSCLQSRIFPRTFGGGTKLEIKGSTSGSGKPG SGEGSTKGQIQLVQSGPELKKPGETVKISCKASGY TFTDYSINWVKRAPGKGLKWMGWINTETREPAY | 1170 | 5255 |

TABLE 22-continued

BCMA CAR

| Description | Amino Acid Sequence | Amino Acid SEQ ID NO. | Nucleic Acid SEQ ID NO. |
|---|---|---|---|
| 159 of WT)(R12Y, Y100I) - stop) | AYDFRGRFAFSLETSASTAYLQINNLKYEDTATYF CALDYSYAMDYWGQGTSVTVSSTTTPAPRPPTPA PTIASQPLSLRPEACRPAAGGAVHTRGLDFACDIYI WAPLAGTCGVLLLSLVITLYCKRGRKKLLYIFKQP FMRPVQTTQEEDGCSCRFPEEEEGGCELRVKFSRS ADAPAYKQGQNQLYNELNLGRREEYDVLDKRRG RDPEMGGKPRRKNPQEGLYNELQKDKMAEAYSE IGMKGERRRGKGHDGLYQGLSTATKDTYDALHM QALPPRSGISLIAALAVDYVIGMENAMPWNLPAD LAWFKRNTLNKPVIMGRHTWESIGRPLPGRKNIIL SSQPGTDDRVTWVKSVDEAIAACGDVPEIMVIGG GRVIEQFLPKAQKLYLTHIDAEVEGDTHFPDYEPD DWESVFSEFHDADAQNSHSYCFEILERR* | | |

Tandem CAR (TanCAR)

In some embodiments, the CAR of the present invention may be a tandem chimeric antigen receptor (TanCAR) which is able to target two, three, four, or more tumor specific antigens. In some aspects, The CAR is a bispecific TanCAR including two targeting domains which recognize two different TSAs on tumor cells. The bispecific CAR may be further defined as comprising an extracellular region comprising a targeting domain (e.g., an antigen recognition domain) specific for a first tumor antigen and a targeting domain (e.g., an antigen recognition domain) specific for a second tumor antigen. In other aspects, the CAR is a multispecific TanCAR that includes three or more targeting domains configured in a tandem arrangement. The space between the targeting domains in the TanCAR may be between about 5 and about 30 amino acids in length, for example, 6, 7, 8, 9, 10, 11, 12, 13, 14, 15, 16, 17, 18, 19, 20, 21, 22, 23, 24, 25, 26, 27, 28, 29 and 30 amino acids.

Split CAR

In some embodiments, the components including the targeting moiety, transmembrane domain and intracellular signaling domains of the present invention may be split into two or more parts such that it is dependent on multiple inputs that promote assembly of the intact functional receptor. In one embodiment, the split synthetic CAR system can be constructed in which the assembly of an activated CAR receptor is dependent on the binding of a ligand to the SRE (e.g. a small molecule) and a specific antigen to the targeting moiety. As a non-limiting example, the split CAR consists of two parts that assemble in a small molecule-dependent manner; one part of the receptor features an extracellular antigen binding domain (e.g. scFv) and the other part has the intracellular signaling domains, such as the CD3 intracellular domain.

In other aspects, the split parts of the CAR system can be further modified to increase signal. In one example, the second part of cytoplasmic fragment may be anchored to the plasma membrane by incorporating a transmembrane domain (e.g., CD8a transmembrane domain) to the construct. An additional extracellular domain may also be added to the second part of the CAR system, for instance an extracellular domain that mediates homo-dimerization. These modifications may increase receptor output activity, i.e., T cell activation.

In some aspects, the two parts of the split CAR system contain heterodimerization domains that conditionally interact upon binding of a heterodimerizing small molecule. As such, the receptor components are assembled in the presence of the small molecule, to form an intact system which can then be activated by antigen engagement. Any known heterodimerizing components can be incorporated into a split CAR system. Other small molecule dependent heterodimerization domains may also be used, including, but not limited to, gibberellin-induced dimerization system (GID1-GAI), trimethoprim-SLF induced ecDHFR and FKBP dimerization (Czlapinski et al., *J Am Chem Soc.*, 2008, 130(40): 13186-13187) and ABA (abscisic acid) induced dimerization of PP2C and PYL domains (Cutler et al., *Annu Rev Plant Biol.* 2010, 61: 651-679). The dual regulation using inducible assembly (e.g., ligand dependent dimerization) and degradation (e.g., destabilizing domain induced CAR degradation) of the split CAR system may provide more flexibility to control the activity of the CAR modified T cells.

Switchable CAR

In some embodiments, the CAR of the invention may be a switchable CAR. Juilerat et al (Juilerat et al., *Sci. Rep.*, 2016, 6: 18950; the contents of which are incorporated herein by reference in their entirety) recently reported controllable CARs that can be transiently switched on in response to a stimulus (e.g. a small molecule). In this CAR design, a system is directly integrated in the hinge domain that separate the scFv domain from the cell membrane domain in the CAR. Such system is possible to split or combine different key functions of a CAR such as activation and costimulation within different chains of a receptor complex, mimicking the complexity of the TCR native architecture. This integrated system can switch the scFv and antigen interaction between on/off states controlled by the absence/presence of the stimulus.

Reversible CAR

In other embodiments, the CAR of the invention may be a reversible CAR system. In this CAR architecture, a LID domain (ligand-induced degradation) is incorporated into the CAR system. The CAR can be temporarily downregulated by adding a ligand of the LID domain. The combination of LID and DD mediated regulation provides tunable control of continuingly activated CAR T cells, thereby reducing CAR mediated tissue toxicity.

Activation-Conditional CAR

In some embodiments, payloads of the invention may be an activation-conditional chimeric antigen receptor, which is only expressed in an activated immune cell. The expression of the CAR may be coupled to activation conditional control region which refers to one or more nucleic acid sequences that induce the transcription and/or expression of a sequence e.g. a CAR under its control. Such activation conditional control regions may be promoters of genes that are upregulated during the activation of the immune effector cell e.g. IL2 promoter or NFAT binding sites. In some embodiments, activation of the immune cell may be achieved by a constitutively expressed CAR (International Publication No: WO2016126608; the contents of which are incorporated herein by reference in their entirety).

4. Immunotherapeutic Agents

In some embodiments, payloads of the present invention may be immunotherapeutic agents that induce immune responses in an organism. The immunotherapeutic agent may be a cytokine, chemokine, a cytokine receptor, a chemokine receptor, or any agent that induces an immune response. In one embodiment, the immunotherapeutic agent induces an anti-cancer immune response in a cell, or in a subject.

In some embodiments, ligands that do not affect the activity of the immune cell, and/or the chimeric antigen receptor, in the absence of the SREs may be preferably selected.

In some embodiments, the IL12 levels secreted by the immune cells of the invention may approximately be comparable to the IL12 levels secreted by human myeloid dendritic cells (mDC1), when activated with TLR agonists. In one embodiment, the TLR agonist may be the combination of lipopolysaccharide administered with R848.

In some embodiments, the IFN gamma secreted by IL12 induced activation of the immune cells is at least 5 fold greater in the presence of ligand, compared to the levels in the absence of ligand.

In some embodiments, the IFN gamma secreted by IL15 induced activation of the immune cells is at least 10-fold greater in the presence of ligand, compared to the levels in the absence of ligand.

In some embodiments, regulation of IL12 provides the necessary safety switch. In some embodiments, IL12 secretion recruit and/or activates effector cells in the tumor microenvironment. In some embodiments, the IL12 regulation provides a benefit to CAR T function without causing toxicity.

In some embodiments, regulation of IL15-IL15Ra fusion proteins provides a safety switch as compared to constitutively expressed IL15-IL15Ra. In some embodiments, IL15-IL15Ra leads to better expansion, and/or persistence of CAR T cells.

In some embodiments, payloads of the present invention may be immunotherapeutic agents that induce immune responses in an organism. The immunotherapeutic agent may be, but is not limited to a cytokine, a safety switch (e.g., a suicide gene), a regulatory switch, a chimeric antigen receptor, or any agent that induces an immune response. In one embodiment, the immunotherapeutic agent induces an anti-cancer immune response in a cell, or in a subject.

In some embodiments, the payload of the invention may be any of the co-stimulatory molecules and/or intracellular domains described herein. In some embodiments, one or more co-stimulatory molecules, each under the control of different SRE may be used in the present invention. SRE regulated co-stimulatory molecules may also be expressed in conjunction with a first generation CAR, a second generation CAR, a third generation CAR, a fourth generation, or any other CAR design described herein.

Cytokines, Chemokines and Other Soluble Factors

In accordance with the present invention, payloads of the present invention may be cytokines, chemokines, growth factors, and soluble proteins produced by immune cells, cancer cells and other cell types, which act as chemical communicators between cells and tissues within the body. These proteins mediate a wide range of physiological functions, from effects on cell growth, differentiation, migration and survival, to a number of effector activities. For example, activated T cells produce a variety of cytokines for cytotoxic function to eliminate tumor cells.

In accordance with the present invention, CARs of the present invention may be utilized along with other payloads of the present invention may be cytokines, chemokines, growth factors, and soluble proteins produced by immune cells, cancer cells and other cell types, which act as chemical communicators between cells and tissues within the body. These proteins mediate a wide range of physiological functions, from effects on cell growth, differentiation, migration and survival, to a number of effector activities. For example, activated T cells produce a variety of cytokines for cytotoxic function to eliminate tumor cells.

In some embodiments, payloads of the present invention may be cytokines, and fragments, variants, analogs and derivatives thereof, including but not limited to interleukins, tumor necrosis factors (TNFs), interferons (IFNs), TGF beta and chemokines. In some embodiments, payloads of the present invention may be cytokines that stimulate immune responses. In other embodiments, payloads of the invention may be antagonists of cytokines that negatively impact anti-cancer immune responses.

In some embodiments, payloads of the present invention may be cytokines, and fragments, variants, analogs and derivatives thereof, including but not limited to interleukins, tumor necrosis factors (TNFs), interferons (IFNs), TGF beta and chemokines. It is understood in the art that certain gene and/or protein nomenclature for the same gene or protein may be inclusive or exclusive of punctuation such as a dash "-" or symbolic such as Greek letters. Whether these are included or excluded herein, the meaning is not meant to be changed as would be understood by one of skill in the art. For example, IL2, IL-2 and IL 2 refer to the same interleukin. Likewise, TNFalpha, TNFα, TNF-alpha, TNF-α, TNF alpha and TNF a all refer to the same protein. In some embodiments, payloads of the present invention may be cytokines that stimulate immune responses. In other embodiments, payloads of the invention may be antagonists of cytokines that negatively impact anti-cancer immune responses.

In one embodiment, the payloads of the present invention may be cytokines fused to TNF alpha ectodomain. Such payloads are produced as membrane associated cytokines fused to the TNF ectodomain. In one embodiment, the cytokine may be shed from the cell surface by the action of membrane associated proteases, and/or proteases in the extracellular space e.g. MMP9. Any of the cytokines described herein may be useful in the present invention. Such cytokine-TNF scaffold constructs may be used to preserve the native sequence of the processed cytokine while preserving regulation.

In some embodiments, payloads of the present invention may be cytokine receptors, recombinant receptors, variants, analogs and derivatives thereof; or signal components of cytokines.

In some embodiments, cytokines of the present invention may be utilized to improve expansion, survival, persistence, and potency of immune cells such as $CD8+T_{EM}$, natural killer cells and tumor infiltrating lymphocytes (TIL) cells used for immunotherapy. In other embodiments, T cells engineered with two or more DD regulated cytokines are utilized to provide kinetic control of T cell activation and tumor microenvironment remodeling. In one aspect, the present invention provides biocircuits and compositions to minimize toxicity related to cytokine therapy. Despite its success in mitigating tumor burden, systemic cytokine therapy often results in the development of severe dose limiting side effects. Two factors contribute to the observed toxicity (a) Pleiotropism, wherein cytokines affect different cells types and sometimes produce opposing effects on the same cells depending on the context (b) Cytokines have short serum half-life and thus need to be administered at high doses to achieve therapeutic effects, which exacerbates the pleiotropic effects. In one aspect, cytokines of the present invention may be utilized to modulate cytokine expression in the event of adverse effects. In some embodiments, cytokines of the present invention may be designed to have prolonged life span or enhanced specificity to minimize toxicity.

In some embodiments, the payload of the present invention may be an interleukin (IL) cytokine. Interleukins (ILs) are a class of glycoproteins produced by leukocytes for regulating immune responses. As used herein, the term "interleukin (IL)" refers to an interleukin polypeptide from any species or source and includes the full-length protein as well as fragments or portions of the protein. In some aspects, the interleukin payload is selected from IL1, IL1alpha (also called hematopoietin-1), IL1beta (catabolin), IL1 delta, IL1epsilon, IL1eta, IL1 zeta, interleukin-1 family member 1 to 11 (IL1F1 to IL1F11), interleukin-1 homolog 1 to 4 (IL1H1 to IL1H4), IL1 related protein 1 to 3 (IL1RP1 to IL1RP3), IL2, IL3, IL4, IL5, IL6, IL7, IL8, IL9, IL10, IL10C, IL10D, IL11, IL11a, IL11b, IL12, IL13, IL14, IL15, IL16, IL17, IL17A, Il17B, IL17C, IL17E, IL17F, IL18, IL19, IL20, IL20 like (IL20L), Il21, IL22, IL23, IL23A, IL23-p19, IL23-p40, IL24, Il25, IL26, IL27, IL28A, IL28B, IL29, IL30, IL31, IL32, IL33, IL34, IL35, IL36 alpha, IL36 beta, IL36 gamma, IL36RN, IL37, IL37a, IL37b, IL37c, IL37d, IL37e and IL38. In other aspects, the payload of the present invention may be an interleukin receptor selected from CD121a, CDw121b, IL2Rα/CD25, IL2Rβ/CD122, IL2Rγ/CD132, CDw131, CD124, CD131, CDw125, CD126, CD130, CD127, CDw210, IL8RA, IL11Ra, CD212, CD213α1, CD213α2, IL14R, IL15Rα, CDw217, IL18Rα, IL18Rβ, IL20Rα, and IL20Rβ.

In one embodiment, the payload of the invention may comprise IL2. In one aspect, the effector module of the invention may be a DD-IL2 fusion polypeptide. The amino acid sequences corresponding to DD-IL2 and its components are listed in the Table 23. The amino acid sequences in Table 23 may comprise a stop codon which is denoted in the table with a "*" at the end of the amino acid sequence.

TABLE 23

DD-IL2 construct sequences

| Description | Amino Acid Sequence | Amino Acid SEQ ID NO | Nucleic Acid SEQ ID NO/ Sequence |
|---|---|---|---|
| IL2 signal sequence | MYRMQLLSCIALSLALVTNS | 2776 | 5256-5257 |
| Linker | EFSTEF | 2777 | 5260 |
| Linker | MH | — | ATGCAC |
| IL2 | APTSSSTKKTQLQLEHLLLDLQMILNGINNYKNPKLTRM LTFKFYMPKKATELKHLQCLEEELKPLEEVLNLAQSKNF HLRPRDLISNINVIVLELKGSETTFMCEYADETATIVEFL NRWITFCQSIISTLT | 743 | 5261-5262 |
| FKBP (F36V, L106P) | GVQVETISPGDGRTFPKRGQTCVVHYTGMLEDGKKVDS SRDRNKPFKFMLGKQEVIRGWEEGVAQMSVGQRAKLTI SPDYAYGATGHPGIIPPHATLVFDVELLKPE | 2778 | 5263-5268 |
| ecDHFR (Amino acid 2-159 of WT)(R12Y, Y100I) | ISLIAALAVDYVIGMENAMPWNLPADLAWFKRNTLNKP VIMGRHTWESIGRPLPGRKNIILSSQPGTDDRVTWVKSV DEAIAACGDVPEIMVIGGGRVIEQFLPKAQKLYLTHIDA EVEGDTHFPDYEPDDWESVFSEFHDADAQNSHSYCFEIL ERR | 2774 | 5238-5244 |
| OT-IL2-001 (IL2 Signal Sequence - Linker (EFSTEF (SEQ ID NO: 3086))- FKBP (F36V, L106P) - Linker (MH) - IL2- stop) | MYRMQLLSCIALSLALVTNSEFSTEFGVQVETISPGDGR TFPKRGQTCVVHYTGMLEDGKKVDSSRDRNKPFKFML GKQEVIRGWEEGVAQMSVGQRAKLTISPDYAYGATGH PGIIPPHATLVFDVELLKPEMHAPTSSSTKKTQLQLEHLL LDLQMILNGINNYKNPKLTRMLTFKFYMPKKATELKHL QCLEEELKPLEEVLNLAQSKNFHLRPRDLISNINVIVLEL KGSETTFMCEYADETATIVEFLNRWITFCQSIISTLT | 1146 | 5269 |
| OT-IL2-002 (IL2 Signal Sequence - IL2- stop) | MYRMQLLSCIALSLALVTNSAPTSSSTKKTQLQLEHLLL DLQMILNGINNYKNPKLTRMLTFKFYMPKKATELKHLQ CLEEELKPLEEVLNLAQSKNFHLRPRDLISNINVIVLELK GSETTFMCEYADETATIVEFLNRWITFCQSIISTLT | 1147 | 5270 |

TABLE 23-continued

DD-IL2 construct sequences

| Description | Amino Acid Sequence | Amino Acid SEQ ID NO | Nucleic Acid SEQ ID NO/ Sequence |
|---|---|---|---|
| OT-IL2-003 (IL2 Signal Sequence - Linker (EFSTEF (SEQ ID NO: 3086))- ecDHFR (Amino acid 2-159 of WT) (R12Y, Y100I) - Linker (MH) - IL2- stop) | MYRMQLLSCIALSLALVTNSEFSTEFISLIAALAVDYVIG MENAMPWNLPADLAWFKRNTLNKPVIMGRHTWESIGR PLPGRKNIILSSQPGTDDRVTWVKSVDEAIAACGDVPEI MVIGGGRVIEQFLPKAQKLYLTHIDAEVEGDTHFPDYEP DDWESVFSEFHDADAQNSHSYCFEILERRMHAPTSSSTK KTQLQLEHLLLDLQMILNGINNYKNPKLTRMLTFKFYM PKKATELKHLQCLEEELKPLEEVLNLAQSKNFHLRPRDL ISNINVIVLELKGSETTFMCEYADETATIVEFLNRWITFC QSIISTLT | 1148 | 5271 |

In some aspects of the invention, an IL2 mutein may be used as a payload. As used herein, the term "mutein" is a construct, molecule or sequence of a mutation, change or alteration in a protein and hence is also known as a mutant, e.g., a protein mutant, mutein. Consequently, an "IL2 mutein" is an IL2 mutant. In some embodiments an IL2 mutein is a variant of wild type IL2 protein, where the wildtype IL2 consists of the amino acid sequence of SEQ ID NO: 5272. In some aspects, it refers to an IL2 variant which binds to and activates only cells expressing IL2Rαβγ, but does not significantly bind to or activate cell expressing only IL2Rβγ. In some examples, an IL2 mutein may be an IL2 protein in which residues of IL2 responsible for binding to either IL2Rβ or IL2Rγ are substituted to abolish the interaction of IL2 with IL2Rβ or IL2Rγ. In other examples, an IL2 mutein may be an IL2 protein comprising mutations conferring high affinity for IL2Rα. An IL2 mutein may be an IL2 selective agonist (IL2SA) which can preferentially activate the high affinity IL2 receptor (i.e., IL2Rαβγ) which is necessary to selectively activate T cells with respect to NK cells. In some embodiments, the IL2 mutein may be IL2 protein which preferentially binds to the lower affinity IL2Rβγ but with reduced affinity to CD25.

In some embodiments, IL2 muteins may be used to preferentially expand or stimulate Treg cells. As used herein "preferentially expand or stimulate Treg cells" means the IL2 muteins promote the proliferation, survival, activation and/or function of T regulatory cells.

Exemplary IL2 muteins may include, but are not limited to, N88R substitution (Shanafelt et al., Nature Biotech., 2000, 18:1197-1202), an IL2 with a V91K substitution (e.g., US Patent publication NO. US20140286898); V91K substitution, C125A substitution, an IL2 with three mutations: V69A, N71R, Q74P; an IL2 mutein with high affinity for IL2Rα (N29S, Y31H, K35R, T37A, K48E, V69A, N71R, Q74P); an IL2 mutein with high affinity for IL2Rα and reduced signaling activity (N29S, Y31H, K35R, T37A, K48E, V69A, N71R, Q74P, N88D), and D20H, D20I, N88G, N88I, N88R, and Q126L substitutions as described in PCT application NO. 1999060128; the contents of each of which are incorporated herein by reference in their entirety. In other aspects, IL2 muteins may include those described in U.S. Pat. Nos. 4,518,584; 5,116,943; 5,206,344; 6,955,807; 7,105,653; 7,371,371; 7,803,361; 8,124,066; 8,349,311; 8,759,486; and 9,206,243; PCT patent publication NOs. WO2005086751 and WO2012088446; European Patent N.s.: EP0234599 and EP0200280 and Sim, G. C. et al. (2016) Cancer Immunol Res; 4(11):983-994; the contents of each of which are incorporated herein by reference in their entirety.

In some aspects, the IL2 mutein may be fused to a polypeptide that extends the serum half-life of the IL2 mutein, such as an IgG Fc fragment. Preferred Fc regions are derived from human IgG, which includes IgG1, IgG2, IgG3, and IgG4. In other aspects, the payload of the invention may be an IL2 fusion protein comparing a second functional polypeptide. In a non-limiting example, an IL2 fusion protein may comprise an IL2 or IL2 mutein polypeptide fused with a pro-apoptotic Bcl-2 family polypeptide (such as Bad, Bik/Nbk, Bid, Bim/Bod, Hrk, Bak or Bax); such fusion protein may be capable of inhibiting cell survival, inhibiting cell proliferation, or enhancing cell death or apoptosis of a target cell expressing an IL2 receptor. Alternatively, an IL2 or IL2 mutein polypeptide may be fused with an anti-apoptotic Bcl-2 family polypeptide (such as Bcl-x$_L$, Bcl-w or Bcl-2). The fusion protein may be capable of enhancing cell survival, enhancing cell proliferation, or inhibiting cell death or apoptosis of a target cell expressing an IL2 receptor. See, e.g., US patent publication NOS. US2016/0229901.

In addition, the IL2 fusion protein may be a IL2-GMCSF fusion protein which can promote cell-cell interaction; therefore, enhances anti-cancer immune responses (Wen et al., J. Translational Med., 2016, 14: 41).

In one embodiment, the payload of the invention may comprise IL12. IL12 is a heterodimeric protein of two subunits (p35, p40) that is secreted by antigen presenting cells, such as macrophages and dendritic cells. Expression of IL12 requires the simultaneous expression of the two subunits to produce a biologically active heterodimer. In some embodiments, payloads of the invention may be p35 subunit or the p40 subunit. IL12 is type 1 cytokine that acts on natural killer (NK) cells, macrophages, CD8$^+$ Cytotoxic T cells, and CD4$^+$ T helper cells through STAT4 pathway to induce IFN-γ production in these effector immune cells (reviewed by Trinchieri G, Nat Rev Immunol. 2003; 3(2): 133-146). IL12 can promote the cytotoxic activity of NK cells and CD8$^+$ T cells, therefore has anti-tumor function as well as promote T cell persistence in vivo. Intravenous injection of recombinant IL12 exhibited modest clinical efficacy in a handful of patients with advanced melanoma and renal cell carcinoma (Gollob et al., Clin. Cancer Res. 2000; 6(5): 1678-1692). IL12 has been used as an adjuvant to enhance cytotoxic immunity using a melanoma antigen vaccine, or using peptide pulsed peripheral blood mononuclear cells; and to promote NK cell activity in breast cancer with trastuzumab treatment. Local delivery of IL12 to the tumor microenvironment promotes tumor regression in several tumor models. These studies all indicate that locally increased IL12 level can promote anti-tumor immunity. One major obstacle of systemic or local administration of recombinant IL12 protein, or through oncolytic viral vectors is the severe side effects when IL12 is presented at high level. Developing a system that tightly controls IL12 level may provide a safe use of IL12 in cancer treatment. A regulatable IL12 composition may also prevent negative feedback loops, thereby enhancing T cell effector functions.

In one aspect, the effector module of the invention may be a DD-IL12 fusion polypeptide. This regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer. The need for harsh preconditioning regimens in current adoptive cell therapies may be minimized using regulated IL12 DD-IL12 may be utilized to modify tumor microenvironment and increase persistence in solid tumors that are currently refractory to tumor antigen targeted therapy. In some embodiments, CAR expressing T cells may be armored with DD regulated IL12 to relieve immunosuppression without systemic toxicity. In some embodiments, the payloads of the present invention may be used to enhance cell therapies with performance optimized for challenging tumor microenvironments.

In some embodiments, the IL12 may be a Flexi IL12, wherein both p35 and p40 subunits, are encoded by a single cDNA that produces a single chain polypeptide. The single chain polypeptide may be generated by placing p35 subunit at the N terminus or the c terminus of the single chain polypeptide. Similarly, the p40 subunit may be at the N terminus or C terminus of the single chain polypeptide. In some embodiments, the IL12 constructs of the invention may be placed under the transcriptional control of the CMV promoter (SEQ ID NO. 5273), an EF1a promoter (SEQ ID NO. 5274, SEQ ID NO. 5276) or a PGK promoter (SEQ ID NO. 5275). Any portion of IL12 that retains one or more functions of full length or mature IL12 may be useful in the present invention. In some aspects, the DD-L12 comprises the amino acid sequences listed in Table 24. The amino acid sequences in Table 24 may comprise a stop codon which is denoted in the table with a "*" at the end of the amino acid sequence.

TABLE 24

DD-IL12 constructs

| Description | Promoter | Amino acid Sequence | Amino acid SEQ ID NO | Nucleic Acid SEQ ID NO |
| --- | --- | --- | --- | --- |
| p40 signal sequence | — | MCHQQLVISWFSLVFLASPLVA | 2748 | 5277-5285 |
| Linker | — | GGSGG | 2754 | 5286-5287 |
| Linker | — | GGGGSGGGGSGGGGS | 2755 | 5288-5293 |
| Linker | | GS | — | GGATCC |
| Spacer | | ATNFSLLKQAGDVEENPGP | 2779 | 5294 |
| Furin cleavage site | — | SARNRQKRS | 2780 | 5295 |
| Furin cleavage site | — | ARNRQKRS | 2781 | 5296 |
| Modified Furin 5299 | — | ESRRVRRNKRSK | 2759 | 5297- |
| P2A Cleavable Peptide | — | GATNFSLLKQAGDVEENPGP | 2782 | 5300 |
| p40 | — | IWELKKDVYVVELDWYPDAPGEMVVLTCD TPEEDGITWTLDQSSEVLGSGKTLTIQVKEF GDAGQYTCHKGGEVLSHSLLLLHKKEDGI WSTDILKDQKEPKNKTFLRCEAKNYSGRFT CWWLTTISTDLTFSVKSSRGSSDPQGVTCG AATLSAERVRGDNKEYEYSVECQEDACP AAEESLPIEVMVDAVHKLKYENYTSSFFIRD IIKPDPPKNLQLKPLKNSRQVEVSWEYPDT WSTPHSYFSLTFCVQVQGKSKREKKDRVFT DKTSATVICRKNASISVRAQDRYYSSSWSE WASVPCS | 2749 | 5301-5313 |
| p40 (K217N) | - | IWELKKDVYVVELDWYPDAPGEMVVLTCD TPEEDGITWTLDQSSEVLGSGKTLTIQVKEF GDAGQYTCHKGGEVLSHSLLLLHKKEDGI WSTDILKDQKEPKNKTFLRCEAKNYSGRFT CWWLTTISTDLTFSVKSSRGSSDPQGVTCG AATLSAERVRGDNKEYEYSVECQEDSACP AAEESLPIEVMVDAVHKLKYENYTSSFFIRD IIKPDPPNNLQLKPLKNSRQVEVSWEYPDT | 2783 | 5314 |

TABLE 24-continued

DD-IL12 constructs

| Description | Promoter | Amino acid Sequence | Amino acid SEQ ID NO | Nucleic Acid SEQ ID NO |
|---|---|---|---|---|
| | | WSTPHSYFSLTFCVQVQGKSKREKKDRVFT DKTSATVICRKNASISVRAQDRYYSSSWSE WASVPCS | | |
| p35 | – | RNLPVATPDPGMFPCLHHSQNLLRAVSNM LQKARQTLEFYPCTSEEIDHEDITKDKTSTV EACLPLELTKNESCLNSRETSFITNGSCLASR KTSFMMALCLSSIYEDLKMYQVEFKTMNA KLLMDPKRQIFLDQNMLAVIDELMQALNF NSETVPQKSSLEEPDFYKTKIKLCILLHAFRI RAVTIDRVMSYLNAS | 2750 | 5315-5325 |
| p35 | – | RNLPVATPDPGMFPCLHHSQNLLRAVSNML QKARQTLEFYPCTSEEIDHEDITKDKTSTVE ACLPLELTKNESCLNSRETSFITNGSCLASRK TSFMMALCLSSIYEDLKMYQVEF-KTMNAKLLMDPKRQIFLDQNMLAVIDELM QALNFNSETVPQKSSLEEPDFYKTKIKLCILL HAFRIRAVTIDRVMSYLNAS* | 735 | 5327-5336 |
| ecDHFR (Amino acid 2-159 of WT) (R12Y, Y100I) | – | ISLIAALAVDYVIGMENAMPWNLPADLAW FKRNTLNKPVIMGRHTWESIGRPLPGRKNII LSSQPGTDDRVTWVKSVDEAIAACGDVPEI MVIGGGRVIEQFLPKAQKLYLTHIDAEVEG DTHFPDYEPDDWESVFSEFHDADAQNSHSY CFEILERR | 1174 | 5338-5343 |
| FKBP(F36V, L106P) | - | GVQVETISPGDGRTFPKRGQTCVVHYTGML EDGKKVDSSRDRNKPFKFMLGKQEVIRGW EEGVAQMSVGQRAKLTISPDYAYGATGHP GIIPPHATLVFDVELLKPE | 1176 | 5345-5349 |
| FKBP(F36V, E31G, R71G, K105E) | - | GVQVETISPGDGRTFPKRGQTCVVHYTGML GDGKKVDSSRDRNKPFKFMLGKQEVIRGW EEGVAQMSVGQGAKLTISPDYAYGATGHP GIIPPHATLVFDVELLELE | 1177 | 5351-5357 |
| hDHFR (Amino acid 2-187 of WT; Q36F, Y122I, A125F) | – | VGSLNCIVAVSQNMGIGKNGDLPWPPLRNE FRYFFRMTTTSSVEGKQNLVIMGKKTWFSI PEKNRPLKGRINLVLSRELKEPPQGAHFLSR SLDDALKLTEQPELANKVDMVWIVGGSSVI KEFMNHPGHLKLFVTRIMQDFESDTFFPEID LEKYKLLPEYPGVLSDVQEEKGIKYKFEVY EKND | 1230 | 5358 |
| hDHFR (Amino acid 2-187 of WT) (I17V) | – | VGSLNCIVAVSQNMGVGKNGDLPWPPLRN EFRYFQRMTTTSSVEGKQNLVIMGKKTWFS IPEKNRPLKGRINLVLSRELKEPPQGAHFLS RSLDDALKLTEQPELANKVDMVWIVGGSS VYKEAMNHPGHLKLFVTRIMQDFESDTFFP EIDLEKYKLLPEYPGVLSDVQEEKGIKYKFE VYEKND | 1256 | 5359 |
| hDHFR (Amino acid 2-187 of WT) (Y122I) | – | VGSLNCIVAVSQNMGIGKNGDLPWPPLRNE FRYFQRMTTTSSVEGKQNLVIMGKKTWFSI PEKNRPLKGRINLVLSRELKEPPQGAHFLSR SLDDALKLTEQPELANKVDMVWIVGGSSVI KEAMNHPGHLKLFVTRIMQDFESDTFFPEID LEKYKLLPEYPGVLSDVQEEKGIKYKFEVY EKND | 1257 | 5360-5361 |
| OT-IL12-001 (p40 signal sequence - FKBP(F36V, L106P) - linker (GGSGG(SEQ ID NO: 2729)) - p40 - linker2 (G4S)3 (SEQ ID NO: 2731) - p35- stop) | CMV | MCHQQLVISWFSLVFLASPLVAGVQVETISP GDGRTFPKRGQTCVVHYTGMLEDGKKVDS SRDRNKPFKFMLGKQEVIRGWEEGVAQMS VGQRAKLTISPDYAYGATGHPGIIPPHATLV FDVELLKPEGGSGGIWELKKDVYVVELDW YPDAPGEMVVLTCDTPEEDGITWTLDQSSE VLGSGKTLTIQVKEFGDAGQYTCHKGGEVL SHSLLLLHKKEDGIWSTDILKDQKEPKNKTF LRCEAKNYSGRFTCWWLTTISTDLTFSVKS SRGSSDPQGVTCGAATLSAERVRGDNKEYE YSVECQEDSACPAAEESLPIEVMDAVHKL KYENYTSSFFIRDIIKPDPPKNLQLKPLKNSR | 182 2784 | 5362 |

TABLE 24-continued

DD-IL12 constructs

| Description | Promoter | Amino acid Sequence | Amino acid SEQ ID NO | Nucleic Acid SEQ ID NO |
|---|---|---|---|---|
| | | QVEVSWEYPDTWSTPHSYFSLTFCVQVQG KSKREKKDRVFTDKTSATVICRKNASISVR AQDRYYSSSWSEWASVPCSGGGGSGGGGS GGGGSRNLPVATPDPGMFPCLHHSQNLLRA VSNMLQKARQTLEFYPCTSEEIDHEDITKDK TSTVEACLPLELTKNESCLNSRETSFITNGSC LASRKTSFMMALCLSSIYEDLKMYQVEFKT MNAKLLMDPKRQIFLDQNMLAVIDELMQA LNFNSETVPQKSSLEEPDFYKTKIKLCILLH AFRIRAVTIDRVMSYLNAS* | | |
| OT-IL12-002 (Met - FKBP (F36V, L106P) - linker (GGSGG(SEQ ID NO: 2729)) - p40 signal sequence - p40 - linker ((G4S)3 (SEQ ID NO: 2731)) - p35 - stop) | CMV | MGVQVETISPGDGRTFPKRGQTCVVHYTG MLEDGKKVDSSRDRNKPFKFMLGKQEVIR GWEEGVAQMSVGQRAKLTISPDYAYGATG HPGIIPPHATLVFDVELLKPEGGSGGMCHQ QLVISWFSLVFLASPLVAIWELKKDVYVVE LDWYPDAPGEMVVLTCDTPEEDGITWTLD QSSEVLGSGKTLTIQVKEFGDAGQYTCHKG GEVLSHSLLLLHKKEDGIWSTDILKDQKEP KNKTFLRCEAKNYSGRFTCWWLTTISTDLT FSVKSSRGSSDPQGVTCGAATLSAERVRGD NKEYEYSVECQEDSACPAAEESLPIEVMVD AVHKLKYENYTSSFFIRDIIKPDPPKNLQLK PLKNSRQVEVSWEYPDTWSTPHSYFSLTFC VQVQGKSKREKKDRVFTDKTSATVICRKN ASISVRAQDRYYSSSWSEWASVPCSGGGGS GGGGSGGGGSRNLPVATPDPGMFPCLHHS QNLLRAVSNMLQKARQTLEFYPCTSEEIDH EDITKDKTSTVEACLPLELTKNESCLNSRET SFITNGSCLASRKTSFMMALCLSSIYEDLKM YQVEFKTMNAKLLMDPKRQIFLDQNMLAV IDELMQALNFNSETVPQKSSLEEPDFYKTKI KLCILLHAFRIRAVTIDRVMSYLNAS* | 2785 | 5363 |
| OT-IL12-003 (p40 signal sequence - FKBP(F36V, L106P) - furin (SARNRQKRS (SEQ ID NO: 2732)) - p40- linker ((G4S)3 (SEQ ID NO: 2731))- p35 - stop) | CMV | MCHQQLVISWFSLVFLASPLVAGVQVETISP GDGRTFPKRGQTCVVHYTGMLEDGKKVDS SRDRNKPFKFMLGKQEVIRGWEEGVAQMS VGQRAKLTISPDYAYGATGHPGIIPPHATLV FDVELLKPESARNRQKRSIWELKKDVYVVE LDWYPDAPGEMVVLTCDTPEEDGITWTLD QSSEVLGSGKTLTIQVKEFGDAGQYTCHKG GEVLSHSLLLLHKKEDGIWSTDILKDQKEP KNKTFLRCEAKNYSGRFTCWWLTTISTDLT FSVKSSRGSSDPQGVTCGAATLSAERVRGD NKEYEYSVECQEDSACPAAEESLPIEVMVD AVHKLKYENYTSSFFIRDIIKPDPPKNLQLK PLKNSRQVEVSWEYPDTWSTPHSYFSLTFC VQVQGKSKREKKDRVFTDKTSATVICRKN ASISVRAQDRYYSSSWSEWASVPCSGGGGS GGGGSGGGGSRNLPVATPDPGMFPCLHHS QNLLRAVSNMLQKARQTLEFYPCTSEEIDH EDITKDKTSTVEACLPLELTKNESCLNSRET SFITNGSCLASRKTSFMMALCLSSIYEDLKM YQVEFKTMNAKLLMDPKRQIFLDQNMLAV IDELMQALNFNSETVPQKSSLEEPDFYKTKI KLCILLHAFRIRAVTIDRVMSYLNAS* | 2786 | 5364 |
| OT-IL12-004 (p40 signal sequence - p40 - linker ((G4S)3 (SEQ ID NO: 2731)) - p35 - furin (ARNRQKRS (SEQ ID NO: 2733)) - FKBP (E31G, F36V, R71G, K105E) - stop) | CMV | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN | 2787 | 5365 |

TABLE 24-continued

DD-IL12 constructs

| Description | Promoter | Amino acid Sequence | Amino acid SEQ ID NO | Nucleic Acid SEQ ID NO |
|---|---|---|---|---|
| | | MLAVIDELMQALNFNSETVPQKSSLEEPDF YKTKIKLCILLHAFRIRAVTIDRVMSYLNAS ARNRQKRSGVQVETISPGDGRTFPKRGQTC VVHYTGMLGDGKKVDSSRDRNKPFKFML GKQEVIRGWEEGVAQMSVGQGAKLTISPD YAYGATGHPGIIPPHATLVFDVELLELE* | | |
| OT-IL12-005 (p40 signal sequence- p40 - linker- ((G4S)3 (SEQ ID NO: 2731)) - p35 - linker (GGSG (SEQ ID NO: 2735)) - FKBP (E31G, F36V, R71G, K105E) - stop) | CMV | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS GGSGGVQVETISPGDGRTFPKRGQTCVVHY TGMLGDGKKVDSSRDRNKPFKFMLGKQEV IRGWEEGVAQMSVGQGAKLTISPDYAYGA TGHPGIIPPHATLVFDVELLELE* | 2788 | 5366 |
| OT-IL12-006 (p40 signal sequence- p40 - linker ((G4S)3 (SEQ ID NO: 2731))- p35 - stop) | CMV | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS * | 2789 | 5367 |
| OT-IL12-007 (p40 signal sequence; ecDHFR (Amino acid 2-159 of WT) (R12Y, 100I) - furin site (ESRRVRRNK RSK (SEQ ID NO: 2734)) - p40 - linker ((G4S)3 (SEQ ID NO: 2731)) - p35) | CMV | MCHQQLVISWFSLVFLASPLVAISLIAALAV DYVIGMENAMPWNLPADLAWFKRNTLNK PVIMGRHTWESIGRPLPGRKNIILSSQPGTD DRVTWVKSVDEAIAACGDVPEIMVIGGGR VIEQFLPKAQKLYLTHIDAEVEGDTHFPDYE PDDWESVFSEFHDADAQNSHSYCFEILERR ESRRVRRNKRSKIWELKKDVYVVELDWYP DAPGEMVVLTCDTPEEDGITWTLDQSSEVL GSGKTLTIQVKEFGDAGQYTCHKGGEVLSH SLLLLHKKEDGIWSTDILKDQKEPKNKTFLR CEAKNYSGRFTCWWLTTISTDLTFSVKSSR GSSDPQGVTCGAATLSAERVRGDNKEYEY SVECQEDSACPAAEESLPIEVMVDAVHKLK YENYTSSFFIRDIIKPDPPKNLQLKPLKNSRQ VEVSWEYPDTWSTPHSYFSLTFCVQVQGKS KREKKDRVFTDKTSATVICRKNASISVRAQ DRYYSSSWSEWASVPCSGGGGSGGGGSGG GGSRNLPVATPDPGMFPCLHHSQNLLRAVS NMLQKARQTLEFYPCTSEEIDHEDITKDKTS TVEACLPLELTKNESCLNSRETSFITNGSCL | 2790 | 1835 |

TABLE 24-continued

DD-IL12 constructs

| Description | Promoter | Amino acid Sequence | Amino acid SEQ ID NO | Nucleic Acid SEQ ID NO |
|---|---|---|---|---|
| | | ASRKTSFMMALCLSSIYEDLKMYQVEFKT MNAKLLMDPKRQIFLDQNMLAVIDELMQA LNFNSETVPQKSSLEEPDFYKTKIKLCILLH AFRIRAVTIDRVMSYLNAS | | |
| OT-IL12-008 (p40 signal sequence; hDHFR (Amino acid 2-187 of WT) (Q36K, Y122I, A125F) - furin site (ESRRVRRNK RSK (SEQ ID NO: 2734))- p40 - linken(G4S)3 (SEQ ID NO: 2731)) - p35) | CMV | MCHQQLVISWFSLVFLASPLVAVGSLNCIV AVSQNMGIGKNGDLPWPPLRNEFRYFFRM TTTSSVEGKQNLVIMGKKTWFSIPEKNRPL KGRINLVLSRELKEPPQGAHFLSRSLDDALK LTEQPELANKVDMVWIVGGSSVIKEFMNHP GHLKLFVTRIMQDFESDTFFPEIDLEKYKLL PEYPGVLSDVQEEKGIKYKFEVYEKNDESR RVRRNKRSKIWELKKDVYVVELDWYPDAP GEMVVLTCDTPEEDGITWTLDQSSEVLGSG KTLTIQVKEFGDAGQYTCHKGGEVLSHSLL LLHKKEDGIWSTDILKDQKEPKNKTFLRCE AKNYSGRFTCWWLTTISTDLTFSVKSSRGS SDPQGVTCGAATLSAERVRGDNKEYEYSV ECQEDSACPAAEESLPIEVMVDAVHKLKYE NYTSSFFIRDIIKPDPPKNLQLKPLKNSRQVE VSWEYPDTWSTPHSYFSLTFCVQVQGKSKR EKKDRVFTDKTSATVICRKNASISVRAQDR YYSSSWSEWASVPCSGGGGSGGGGSGGGG SRNLPVATPDPGMFPCLHHSQNLLRAVSNM LQKARQTLEFYPCTSEEIDHEDITKDKTSTV EACLPLELTKNESCLNSRETSFITNGSCLASR KTSFMMALCLSSIYEDLKMYQVEFKTMNA KLLMDPKRQIFLDQNMLAVIDELMQALNF NSETVPQKSSLEEPDFYKTKIKLCILLHAFRI RAVTIDRVMSYLNAS | 2791 | 5369 |
| OT-IL12-009 (p40 signal sequence- p40 - linker ((G4S)3 (SEQ ID NO: 2731)) - p35 - furin (ESRRVRRNK RSK (SEQ ID NO: 2734)) - FKBP (E31G, F36V, R71G, K105E)- stop) | CMV | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS ESRRVRRNKRSKGVQVETISPGDGRTFPKR GQTCVVHYTGMLGDGKKVDSSRDRNKPFK FMLGKQEVIRGWEEGVAQMSVGQGAKLTI SPDYAYGATGHPGIIPPHATLVFDVELLELE * | 2792 | 5370 |
| OT-IL12-019 (p40 signal sequence- p40-linker((G4S)3 (SEQ ID NO: 2731))- p35-stop) | PGK | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS | 2789 | 5367 |

TABLE 24-continued

DD-IL12 constructs

| Description | Promoter | Amino acid Sequence | Amino acid SEQ ID NO | Nucleic Acid SEQ ID NO |
|---|---|---|---|---|
| | | RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS * | | |
| OT-IL12-020 (p40 signal sequence- p40-linker((G4S)3 (SEQ ID NO: 2731))- p35-stop) | EF1a | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS * | 2789 | 5367 |
| OT-IL12-021 (p40 signal sequence- p40-linker((G4S)3 (SEQ ID NO: 2731))- p35-stop) | No promoter | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS * | 2789 | 5367 |
| OT-IL12-022 (p40 signal sequence- p40 -linker- ((G4S)3 (SEQ ID NO: 2731)) - p35 -linker (GGSG (SEQ ID NO: 2735)) - FKBP (E31G, F36V, R71G, K105E) -stop) | PGK | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS GGSGGVQVETISPGDGRTFPKRGQTCVVHY TGMLGDGKKVDSSRDRNKPFKFMLGKQEV IRGWEEGVAQMSVGQGAKLTISPDYAYGA TGHPGIIPPHATLVFDVELLELE* | 2788 | 5366 |

TABLE 24-continued

DD-IL12 constructs

| Description | Promoter | Amino acid Sequence | Amino acid SEQ ID NO | Nucleic Acid SEQ ID NO |
|---|---|---|---|---|
| OT-IL12-023 (p40 signal sequence- p40 - linker- ((G4S)3 (SEQ ID NO: 2731)) - p35 - linker (GGSG (SEQ ID NO: 2735)) - FKBP (E31G, F36V, R71G, K105E) - stop) | EF1a | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS GGSGGVQVETISPGDGRTFPKRGQTCVVHY TGMLGDGKKVDSSRDRNKPFKFMLGKQEV IRGWEEGVAQMSVGQGAKLTISPDYAYGA TGHPGIIPPHATLVFDVELLELE | 2788 | 5366 |
| OT-IL12-024 (p40 signal sequence- p40 - linker- ((G4S)3 (SEQ ID NO: 2731)) - p35 - linker (GGSG (SEQ ID NO: 2735)) - FKBP (E31G, F36V, R71G, K105E) - stop) | No promoter | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS GGSGGVQVETISPGDGRTFPKRGQTCVVHY TGMLGDGKKVDSSRDRNKPFKFMLGKQEV IRGWEEGVAQMSVGQGAKLTISPDYAYGA TGHPGIIPPHATLVFDVELLELE* | 2788 | 5366 |
| OT-IL12-025 (p40 signal sequence- p40 - linker- ((G4S)3 (SEQ ID NO: 2731)) - p35 - linker (GGSG (SEQ ID NO: 2735)) - FKBP (E31G, F36V, R71G, K105E) - stop) | PGK | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS GGSGGVQVETISPGDGRTFPKRGQTCVVHY TGMLGDGKKVDSSRDRNKPFKFMLGKQEV IRGWEEGVAQMSVGQGAKLTISPDYAYGA TGHPGIIPPHATLVFDVELLELE* | 2788 | 5366 |

TABLE 24-continued

DD-IL12 constructs

| Description | Promoter | Amino acid Sequence | Amino acid SEQ ID NO | Nucleic Acid SEQ ID NO |
|---|---|---|---|---|
| OT-IL12-026 (p40 signal sequence- p40 - linker- ((G4S)3 (SEQ ID NO: 2731)) - p35 - linker (GGSG (SEQ ID NO: 2735)) - FKBP (E31G, F36V, R71G, K105E) - stop) | EF1a | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS GGSGGVQVETISPGDGRTFPKRGQTCVVHY TGMLGDGKKVDSSRDRNKPFKFMLGKQEV IRGWEEGVAQMSVGQGAKLTISPDYAYGA TGHPGIIPPHATLVFDVELLELE* | 2788 | 5366 |
| OT-IL 12 -027 (p40 signal sequence- p40 - linker- ((G4S)3 (SEQ ID NO: 2731)) - p35 - linker (GGSG (SEQ ID NO: 2735)) - FKBP (E31G, F36V, R71G, K105E) - stop) | No promoter | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS GGSGGVQVETISPGDGRTFPKRGQTCVVHY TGMLGDGKKVDSSRDRNKPFKFMLGKQEV IRGWEEGVAQMSVGQGAKLTISPDYAYGA TGHPGIIPPHATLVFDVELLELE* | 2788 | 5366 |
| OT-IL12-028 (p40 signal sequence - p40 - linker ((G4S)3 (SEQ ID NO: 2731)) - p35 - furin (ARNRQKRS (SEQ ID NO: 2733)) - FKBP (E31G, F36V, R71G, K105E) - stop) | PGK | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS ARNRQKRSGVQVETISPGDGRTFPKRGQTC VVHYTGMLGDGKKVDSSRDRNKPFKFML GKQEVIRGWEEGVAQMSVGQGAKLTISPD YAYGATGHPGIIPPHATLVFDVELLELE* | 2787 | 5365 |

TABLE 24-continued

DD-IL12 constructs

| Description | Promoter | Amino acid Sequence | Amino acid SEQ ID NO | Nucleic Acid SEQ ID NO |
|---|---|---|---|---|
| OT-IL12-029 (p40 signal sequence- p40 - linker ((G4S)3 (SEQ ID NO: 2731)) - p35 - furin (ESRRVRRNK RSK (SEQ ID NO: 2734)) - FKBP (E31G, F36V, R71G, K105E)- stop) | EF1a | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS ESRRVRRNKRSKGVQVETISPGDGRTFPKR GQTCVVHYTGMLGDGKKVDSSRDRNKPFK FMLGKQEVIRGWEEGVAQMSVGQGAKLTI SPDYAYGATGHPGIIPPHATLVFDVELLELE * | 2792 | 5370 |
| OT-IL12-030 (p40 signal sequence- p40 - linker ((G4S)3 (SEQ ID NO: 2731)) - p35 - furin (ESRRVRRNK RSK (SEQ ID NO: 2734)) - FKBP (E31G, F36V, R71G, K105E)- stop) | No promoter | MCHQQLVISWFSLVFLASPLVAIWELKKDV YVVELDWYPDAPGEMVVLTCDTPEEDGIT WTLDQSSEVLGSGKTLTIQVKEFGDAGQYT CHKGGEVLSHSLLLLHKKEDGIWSTDILKD QKEPKNKTFLRCEAKNYSGRFTCWWLTTIS TDLTFSVKSSRGSSDPQGVTCGAATLSAER VRGDNKEYEYSVECQEDSACPAAEESLPIE VMVDAVHKLKYENYTSSFFIRDIIKPDPPKN LQLKPLKNSRQVEVSWEYPDTWSTPHSYFS LTFCVQVQGKSKREKKDRVFTDKTSATVIC RKNASISVRAQDRYYSSSWSEWASVPCSGG GGSGGGGSGGGGSRNLPVATPDPGMFPCL HHSQNLLRAVSNMLQKARQTLEFYPCTSEE IDHEDITKDKTSTVEACLPLELTKNESCLNS RETSFITNGSCLASRKTSFMMALCLSSIYED LKMYQVEFKTMNAKLLMDPKRQIFLDQN MLAVIDELMQALNFNSETVPQKSSLEEPDF YKTKIKLCILLHAFRIRAVTIDRVMSYLNAS ESRRVRRNKRSKGVQVETISPGDGRTFPKR GQTCVVHYTGMLGDGKKVDSSRDRNKPFK FMLGKQEVIRGWEEGVAQMSVGQGAKLTI SPDYAYGATGHPGIIPPHATLVFDVELLELE * | 2792 | 5370 |
| OT-IL12-046 (p40 signal sequence - FKBP(F36V, L106P) - Linker (GGSGG (SEQ ID NO: 2729)) - p40 - Linker ((G4S)3 (SEQ ID NO: 2731)) - p35 - stop) | EF1a | MCHQQLVISWFSLVFLASPLVAGVQVETISP GDGRTFPKRGQTCVVHYTGMLEDGKKVDS SRDRNKPFKFMLGKQEVIRGWEEGVAQMS VGQRAKLTISPDYAYGATGHPGIIPPHATLV FDVELLKPEGGSGGIWELKKDVYVVELDW YPDAPGEMVVLTCDTPEEDGITWTLDQSSE VLGSGKTLTIQVKEFGDAGQYTCHKGGEVL SHSLLLLHKKEDGIWSTDILKDQKEPKNKTF LRCEAKNYSGRFTCWWLTTISTDLTFSVKSS RGSSDPQGVTCGAATLSAERVRGDNKEYE YSVECQEDSACPAAEESLPIEVMVDAVHKL KYENYTSSFFIRDIIKPDPPKNLQLKPLKNSR QVEVSWEYPDTWSTPHSYFSLTFCVQVQGK SKREKKDRVFTDKTSATVICRKNASISVRAQ DRYYSSSWSEWASVPCSGGGGSGGGGSGG GGSRNLPVATPDPGMFPCLHHSQNLLRAVS NMLQKARQTLEFYPCTSEEIDHEDITKDKTS TVEACLPLELTKNESCLNSRETSFITNGSCLA SRKTSFMMALCLSSIYEDLKMYQVEFKTMN AKLLMDPKRQIFLDQNMLAVIDELMQALNF NSETVPQKSSLEEPDFYKTKIKLCILLHAFRI RAVTIDRVMSYLNAS* | 2784 | 5373 |

In some embodiments, the IL12 may be a Flexi IL12, wherein both p35 and p40 subunits, are encoded by a single cDNA that produces a single chain polypeptide. The single chain polypeptide may be generated by placing p35 subunit at the N terminus or the c terminus of the single chain polypeptide. Similarly, the p40 subunit may be at the N terminus or C terminus of the single chain polypeptide. In some embodiments, the IL12 constructs of the invention may be placed under the transcriptional control of the CMV promoter (SEQ ID NO. 5374), an EF1a promoter (SEQ ID NO. 5375, and SEQ ID NO. 5376) or a PGK promoter (SEQ ID NO. 5377). Any portion of IL12 that retains one or more functions of full length or mature IL12 may be useful in the present invention. In some aspects, the DD-IL12 comprises the amino acid sequences listed in Table 24. The components signal sequences, linker, cleavage sites, payload and destabilizing domains may be assembled in any order to design constructs with optimal features. In some embodiments, such optimal features may include low to virtually no basal expression in the absence of the ligand and increased expression in the presence of ligand. In Table 24, the amino acid sequences may comprise a stop codon at the end which is denoted in the table with a "*".

In some embodiments, DD regulated IL12 compositions of the invention may be utilized to minimize the cytotoxicities associated with systemic IL12 administration. Treatment with IL12 has been associated with systemic flu-like symptoms (fever, chills, fatigue, arthromyalgia, headache), toxic effects on the bone marrow, and liver. Hematologic toxicity observed most commonly included neutropenia and thrombocytopenia; hepatic dysfunction manifested in transient (dose dependent) increase in transaminases, hyperbilirubinemia and hypoalbuminemia. In some instances, toxicity is also associated with inflammation of the mucus membranes (oral mucositis, stomatitis or colitis). These toxic effects of IL12 were related to the secondary production of IFNgamma, TNFalpha, and chemokines such as IP10, and MIG. In certain aspects of the invention, DD regulated IL12 may be utilized to prevent the toxic effects associated with elevated production of secondary messengers.

The format of the IL12 constructs utilized as payload of the present invention may be optimized. In one embodiment, the payload of the invention may be a bicistronic IL12 containing p40 and p35 subunits separated by an internal ribosome entry site or a cleavage site such as P2A or Furin to allow independent expression of both subunits from a single vector. This results in a configuration of secreted IL12 that is more akin to the naturally occurring IL12 than the flexi IL12 construct, the payload of the invention may be the p40 subunit of the IL12. DD regulated p40 may be co-expressed with constitutive p35 construct to generate "regulatable IL12" expression. Alternatively, the DD regulated p40 may heterodimerize with the endogenous p35. p40 has been shown to stabilize p35 expression and stimulate the export of p35 (Jalah R, et al. (2013). *Journal of Biol. Chem.* 288, 6763-6776 (the contents of which are incorporated by reference in its entirety).

In some embodiments, modified forms of IL12 may be utilized as the payload. These modified forms of IL12 may be engineered to have shortened half-life in vivo compared to the non-modified form of especially when used in combination with tunable systems described herein.

Human flexi IL12 has a reported half-life of 5-19 hours which, when administered as a therapeutic compound, can result in systemic cytotoxicity (Car et al. (1999) The Toxicology of Interleukin-12: A Review" *Toxicologic Path.* 27 A, 58-63; Robertson et al. (1999) "Immunological Effects of Interleukin 12 Administered by Bolus Intravenous Injection to Patients with Cancer" *Clin. Cancer Res.* 5:9-16; Atkins et al. (1997)"Phase I Evaluation of Intravenous Recombinant Human Interleukin 12 in Patients with Advance Malignancies" Clin. Cancer Res. 3:409-417). The ligand inducible control of IL12 can regulate production in a dose dependent fashion, the time from cessation of ligand dosing to cessation of protein synthesis and IL12 clearance may be insufficient to prevent toxic accumulation of IL12 in plasma.

In one embodiment, the modified form of IL12 utilized as the payload may be a Topo-sc IL12 which have the configuration as follows from N to C terminus (i) a first IL12 p40 domain (p40N), (ii) an optional first peptide linker, (iii) an IL12 p35 domain, (iv) an optional second peptide linker, and (v) a second IL12 p40 domain (p40C). In one embodiment, modified topo sc IL12 polypeptides exhibit increased susceptibility to proteolysis. Topo-sc IL12 is described in International Patent Publication No. WO2016048903; the contents of which are incorporated herein by reference in its entirety.

IL12 polypeptide may also be modified (e.g. genetically, synthetically, or recombinantly engineered) to increase susceptibility to proteinases to reduce the biologically active half-life of the IL12 complex, compared to a corresponding IL12 lacking proteinases susceptibility. Proteinase susceptible forms of IL12 are described in International Patent Publication No. WO2017062953; the contents of which are incorporated by reference in its entirety.

IL12 systemic toxicity may also be limited or tightly controlled via mechanisms involving tethering IL12 to the cell surface to limit its therapeutic efficacy to the tumor site. Membrane tethered IL12 forms have been described previously using Glycosyl phosphatidylinositol (GPI) signal peptide or using CD80 transmembrane domain (Nagarajan S, et al. (2011) *J Biomed Mater Res A.* 99(3):410-7; Bozeman E N, et al. (2013) Vaccine. 7; 31(20):2449-56; Wen-Yu Pan et al. (2012), *Mol. Ther.* 20:5, 927-937; the contents of each of which are incorporated by reference in their entirety).

In one embodiment, the payload of the invention may comprise IL15. Interleukin 15 is a potent immune stimulatory cytokine and an essential survival factor for T cells, and Natural Killer cells. Preclinical studies comparing IL2 and IL 5, have shown than TL 5 is associated with less toxicity than IL2. In some embodiments, the effector module of the invention may be a DD-IL15 fusion polypeptide. IL15 polypeptide may also be modified to increase its binding affinity for the L 5 receptor. For example, the asparagine may be replaced by aspartic acid at position 72 of IL15 (SEQ ID NO. 2 of US patent publication US20140134128A1; the contents of which are incorporated by reference in their entirety). In some embodiments, the IL15 constructs of the invention may be placed under the transcriptional control of the CMV promoter (SEQ ID NO. 5378), an EF1a promoter (SEQ ID NO. 5379, SEQ ID NO. 5380) or a PGK promoter (SEQ ID NO. 5381). In some aspects, the DD-IL15 comprises the amino acid sequences listed in Table 25. The amino acid sequences in Table 25 may comprise a stop codon which is denoted in the table with a "*" at the end of the amino acid sequence.

TABLE 25

DD IL15 constructs

| Description/ Construct ID | Promoter | Amino Acid Sequence | Amino Acid SEQ ID NO | Nucleic Acid SEQ ID NO |
|---|---|---|---|---|
| IL2 signal sequence | — | MYRMQLLSCIALSLALVTNS | 2793 | 5382-5385 |
| IgE Leader | — | MDWTWILFLVAAATRVHS | 2794 | 5386-5388 |
| Linker | — | EFSTEF | 2795 | 5389-5390 |
| Linker | — | GGSGG | 2754 | 5391-5395 |
| HA Tag | — | YPYDVPDYA | 3080 | 5396-5398 |
| BamHI | — | GS | — | GGATCC |
| P2A Cleavable Peptide | — | GATNFSLLKQAGDVEENPGP | 3081 | 5399 |
| mCherry (M1L) | — | LSKGEEDNMAIIKEFMRFKVHMEGSVNG HEFEIEGEGEGRPYEGTQTAKLKVTKGGP LPFAWDILSPQFMYGSKAYVKHPADIPDY LKLSFPEGFKWERVMNFEDGGVVTVTQD SSLQDGEFIYKVKLRGTNFPSDGPVMQKK TMGWEASSERMYPEDGALKGEIKQRLKL KDGGHYDAEVKTTYKAKKPVQLPGAYN VNIKLDITSHNEDYTIVEQYERAEGRHSTG GMDELYK | 2753 | 5400 |
| IL15 | — | NWVNVISDLKKIEDLIQSMHIDATLYTES DVHPSCKVTAMKCFLLELQVISLESGDASI HDTVENLIILANNSLSSNGNVTESGCKECE ELEEKNIKEFLQSFVHIVQMFINTS* | 2751 | 5401-5405 |
| ecDHFR (Amino acid 2-159 of WT) (R12Y, Y100I) | — | ISLIAALAVDYVIGMENAMPWNLPADLA WFKRNTLNKPVIMGRHTWESIGRPLPGRK NIIILSSQPGTDDRVTWVKSVDEAIAACGD VPEIMVIGGGRVIEQFLPKAQKLYLTHIDA EVEGDTHFPDYEPDDWESVFSEFHDADA QNSHSYCFEILERR* | 1174 | 5168-5173 |
| hDHFR (Amino acid 2-187 of WT) (Y122I) | — | VGSLNCIVAVSQNMGIGKNGDLPWPPLR NEFRYFQRMTTTSSVEGKQNLVIMGKKT WFSIPEKNRPLKGRINLVLSRELKEPPQGA HFLSRSLDDALKLTEQPELANKVDMVWI VGGSSVIKEAMNHPGHLKLFVTRIMQDFE SDTFFPEIDLEKYKLLPEYPGVLSDVQEEK GIKYKFEVYEKND | 1257 | 5160, 5178 |
| OT-IL15-001 (IL2 signal sequence-IL15-stop) | CMV | MYRMQLLSCIALSLALVTNSNWVNVISDL KKIEDLIQSMHIDATLYTESDVHPSCKVTA MKCFLLELQVISLESGDASIHDTVENLIILA NNSLSSNGNVTESGCKECEELEEKNIKEFL QSFVHIVQMFINTS* | 2796 | 5406 |
| OT-IL15-002 (IL2 signal sequence-linker[EFSTEF (SEQ ID NO: 3086)]-ecDHFR (amino acid 2-159 of WT, R12Y, 100I)-linker [GGSGG (SEQ ID NO: 2729)]-IL15-stop) | CMV | MYRMQLLSCIALSLALVTNSEFSTEFISLIA ALAVDYVIGMENAMPWNLPADLAWFKR NTLNKPVIMGRHTWESIGRPLPGRKNIILS SQPGTDDRVTWVKSVDEAIAACGDVPEI MVIGGGRVIEQFLPKAQKLYLTHIDAEVE GDTHFPDYEPDDWESVFSEFHDADAQNS HSYCFEILERRGGSGGNWVNVISDLKKIE DLIQSMHIDATLYTESDVHPSCKVTAMKC FLLELQVISLESGDASIHDTVENLIILANNS LSSNGNVTESGCKECEELEEKNIKEFLQSF VHIVQMFINTS* | 2797 | 5407 |
| OT-IL15-062 (IgE leader-HA Tag-IL15-BamHI (GS)-stop) | EF1a | MDWTWILFLVAAATRVHSYPYDVPDYA NWVNVISDLKKIEDLIQSMHIDATLYTES DVHPSCKVTAMKCFLLELQVISLESGDASI HDTVENLIILANNSLSSNGNVTESGCKECE ELEEKNIKEFLQSFVHIVQMFINTSGS* | 2798 | 5408 |

TABLE 25-continued

DD IL15 constructs

| Description/ Construct ID | Promoter | Amino Acid Sequence | Amino Acid SEQ ID NO | Nucleic Acid SEQ ID NO |
|---|---|---|---|---|
| OT-IL15-132 (IgE leader-IL15-BamHI (GS)-P2A cleavable peptide-mCherry (M1L)-stop) | EF1a | MDWTWILFLVAAATRVHSNWVNVISDLK KIEDLIQSMHIDATLYTESDVHPSCKVTA MKCFLLELQVISLESGDASIHDTVENLIILA NNSLSSNGNVTESGCKECEELEEKNIKEFL QSFVHIVQMFINTSGSGATNFSLLKQAGD VEENPGPLSKGEEDNMAIIKEFMRFKVHM EGSVNGHEFEIEGEGEGRPYEGTQTAKLK VTKGGPLPFAWDILSPQFMYGSKAYVKH PADIPDYLKLSFPEGFKWERVMNFEDGGV VTVTQDSSLQDGEFIYKVKLRGTNFPSDG PVMQKKTMGWEASSERMYPEDGALKGEI KQRLKLKDGGHYDAEVKTTYKAKKPVQ LPGAYNVNIKLDITSHNEDYTIVEQYERA EGRHSTGGMDELYK* | 2799 | 5409 |
| OT-IL15-134 (IgE leader-IL15-Linker (GS)-hDHFR (WT 2-187, Y122I)-BamHI (GS)-P2A cleavable peptide-mCherry (M1L)-stop) | EF1a | MDWTWILFLVAAATRVHSNWVNVISDLK KIEDLIQSMHIDATLYTESDVHPSCKVTA MKCFLLELQVISLESGDASIHDTVENLIILA NNSLSSNGNVTESGCKECEELEEKNIKEFL QSFVHIVQMFINTSGSVGSLNCIVAVSQN MGIGKNGDLPWPPLRNEFRYFQRMTTTSS VEGKQNLVIMGKKTWFSIPEKNRPLKGRI NLVLSRELKEPPQGAHFLSRSLDDALKLT EQPELANKVDMVWIVGGSSVIKEAMNHP GHLKLFVTRIMQDFESDTFFPEIDLEKYKL LPEYPGVLSDVQEEKGIKYKFEVYEKNDG SGATNFSLLKQAGDVEENPGPLSKGEEDN MAIIKEFMRFKVHMEGSVNGHEFEIEGEG EGRPYEGTQTAKLKVTKGGPLPFAWDILS PQFMYGSKAYVKHPADIPDYLKLSFPEGF KWERVMNFEDGGVVTVTQDSSLQDGEFI YKVKLRGTNFPSDGPVMQKKTMGWEAS SERMYPEDGALKGEIKQRLKLKDGGHYD AEVKTTYKAKKPVQLPGAYNVNIKLDITS HNEDYTIVEQYERAEGRHSTGGMDELYK* | 2800 | 5410 |
| IL2 signal sequence | — | MYRMQLLSCIALSLALVTNS | 2793 | 5382-5385 |
| IgE Leader | — | MDWTWILFLVAAATRVHS | 2794 | 5386-5388 |
| Linker | — | EFSTEF | 2795 | 5389-5390 |
| Linker | — | GGSGG | 2754 | 5391-5395 |
| HA Tag | — | YPYDVPDYA | 3080 | 5396-5398 |
| BamHI | — | GS | — | GGATCC |
| P2A Cleavable Peptide | — | GATNFSLLKQAGDVEENPGP | 3081 | 5399 |
| mCherry (M1L) | — | LSKGEEDNMAIIKEFMRFKVHMEGSVNG HEFEIEGEGEGRPYEGTQTAKLVTKGGP LPFAWDILSPQFMYGSKAYVKHPADIPDY LKLSFPEGFKWERVMNFEDGGVVTVTQD SSLQDGEFIYKVKLRGTNFPSDGPVMQKK TMGWEASSERMYPEDGALKGEIKQRLKL KDGGHYDAEVKTTYKAKKPVQLPGAYN VNIKLDITSHNEDYTIVEQYERAEGRHSTG GMDELYK | 2753 | 5400 |
| IL15 | — | NWVNVISDLKKIEDLIQSMHIDATLYTES DVHPSCKVTAMKCFLLELQVISLESGDASI HDTVENLIILANNSLSSNGNVTESGCKECE ELEEKNIKEFLQSFVHIVQMFINTS* | 2751 | 5401-5405 |

TABLE 25-continued

DD IL15 constructs

| Description/ Construct ID | Promoter | Amino Acid Sequence | Amino Acid SEQ ID NO | Nucleic Acid SEQ ID NO |
|---|---|---|---|---|
| ecDHFR (Amino acid 2-159 of WT) (R12Y, Y100I) | — | ISLIAALAVDYVIGMENAMPWNLPADLA WFKRNTLNKPVIMGRHTWESIGRPLPGRK NIILSSQPGTDDRVTWVKSVDEAIAACGD VPEIMVIGGGRVIEQFLPKAQKLYLTHIDA EVEGDTHFPDYEPDDWESVFSEFHDADA QNSHSYCFEILERR* | 1174 | 5168-5173 |
| hDHFR (Amino acid 2-187 of WT) (Y122I) | — | VGSLNCIVAVSQNMGIGKNGDLPWPPLR NEFRYFQRMTTTSSVEGKQNLVIMGKKT WFSIPEKNRPLKGRINLVLSRELKEPPQGA HFLSRSLDDALKLTEQPELANKVDMVWI VGGSSVIKEAMNHPGHLKLFVTRIMQDFE SDTFFPEIDLEKYKLLPEYPGVLSDVQEEK GIKYKFEVYEKND | 1257 | 5160, 5178 |
| OT-IL15-001 (IL2 signal sequence-IL15-stop) | CMV | MYRMQLLSCIALSLALVTNSNWVNVISDL KKIEDLIQSMHIDATLYTESDVHPSCKVTA MKCFLLELQVISLESGDASIHDTVENLIILA NNSLSSNGNVTESGCKECEELEEKNIKEFL QSFVHIVQMFINTS* | 2796 | 5406 |
| OT-IL15-002 (IL2 signal sequence-linker[EFSTEF (SEQ ID NO: 3086)]-ecDHFR (amino acid 2-159 of WT, R12Y, 100I)-linker [GGSGG (SEQ ID NO: 2729)]-IL15-stop) | CMV | MYRMQLLSCIALSLALVTNSEFSTEFISLIA ALAVDYVIGMENAMPWNLPADLAWFKR NTLNKPVIMGRHTWESIGRPLPGRKNIILS SQPGTDDRVTWVKSVDEAIAACGDVPEI MVIGGGRVIEQFLPKAQKLYLTHIDAEVE GDTHFPDYEPDDWESVFSEFHDADAQNS HSYCFEILERRGGSGGNWVNVISDLKKIE DLIQSMHIDATLYTESDVHPSCKVTAMKC FLLELQVISLESGDASIHDTVENLIILANNS LSSNGNVTESGCKECEELEEKNIKEFLQSF VHIVQMFINTS* | 2797 | 5407 |
| OT-IL15-062 (IgE leader-HA Tag-IL15-BamHI (GS)-stop) | EF1a | MDWTWILFLVAAATRVHSYPYDVPDYA NWVNVISDLKKIEDLIQSMHIDATLYTES DVHPSCKVTAMKCFLLELQVISLESGDASI HDTVENLIILANNSLSNGNVTESGCKECE ELEEKNIKEFLQSFVHIVQMFINTSGS* | 2798 | 5408 |
| OT-IL15-132 (IgE leader-IL15-BamHI (GS)-P2A cleavable peptide-mCherry (M1L)-stop) | EF1a | MDWTWILFLVAAATRVHSNWVNVISDLK KIEDLIQSMHIDATLYTESDVHPSCKVTA MKCFLLELQVISLESGDASIHDTVENLIILA NNSLSSNGNVTESGCKECEELEEKNIKEFL QSFVHIVQMFINTSGSGATNFSLLKQAGD VEENPGPLSKGEEDNMAIIKEFMRFKVHM EGSVNGHEFEIEGEGEGRPYEGTQTAKLK VTKGGPLPFAWDILSPQFMYGSKAYVKH PADIPDYLKLSFPEGFKWERVMNFEDGGV VTVTQDSSLQDGEFIYKVKLRGTNFPSDG PVMQKKTMGWEASSERMYPEDGALKGEI KQRLKLKDGGHYDAEVKTTYKAKKPVQ LPGAYNVNIKLDITSHNEDYTIVEQYERA EGRHSTGGMDELYK* | 2799 | 5409 |
| OT-IL15-134 (IgE leader-IL15-Linker (GS)-hDHFR (WT 2-187, Y122I)-BamHI (GS)-P2A cleavable peptide-mCherry (M1L) — stop) | EF1a | MDWTWILFLVAAATRVHSNWVNVISDLK KIEDLIQSMHIDATLYTESDVHPSCKVTA MKCFLLELQVISLESGDASIHDTVENLIILA NNSLSSNGNVTESGCKECEELEEKNIKEFL QSFVHIVQMFINTSGSVGSLNCIVAVSQN MGIGKNGDLPWPPLRNEFRYFQRMTTTSS VEGKQNLVIMGKKTWFSIPEKNRPLKGRI NLVLSRELKEPPQGAHFLSRSLDDALKLT EQPELANKVDMVWIVGGSSVIKEAMNHP GHLKLFVTRIMQDFESDTFFPEIDLEKYKL LPEYPGVLSDVQEEKGIKYKFEVYEKNDG SGATNFSLLKQAGDVEENPGPLSKGEEDN | 2800 | 5410 |

TABLE 25-continued

DD IL15 constructs

| Description/<br>Construct ID | Pro-<br>moter | Amino Acid Sequence | Amino<br>Acid<br>SEQ<br>ID<br>NO | Nucleic<br>Acid<br>SEQ<br>ID<br>NO |
|---|---|---|---|---|
| | | MAIIKEFMRFKVHMEGSVNGHEFEIEGEG<br>EGRPYEGTQTAKLKVTKGGPLPFAWDILS<br>PQFMYGSKAYVKHPADIPDYLKLSFPEGF<br>KWERVMNFEDGGVVTVTQDSSLQDGEFI<br>YKVKLRGTNFPSDGPVMQKKTMGWEAS<br>SERMYPEDGALKGEIKQRLKLKDGGHYD<br>AEVKTTYKAKKPVQLPGAYNVNIKLDITS<br>HNEDYTIVEQYERAEGRHSTGGMDELYK* | | |

In one embodiment, the payload of the invention may comprise whole or a portion of IL15. Interleukin 15 is a potent immune stimulatory cytokine and an essential survival factor for T cells, and Natural Killer cells. Preclinical studies comparing IL2 and IL15, have shown than IL15 is associated with less toxicity than IL2. In some embodiments, the effector module of the invention may be a DD-IL15 fusion polypeptide. IL15 polypeptide may also be modified to increase its binding affinity for the IL15 receptor. For example, the asparagine may be replaced by aspartic acid at position 72 of IL15 (SEQ. ID NO. 2 of US patent publication US20140134128A1; the contents of which are incorporated by reference in their entirety). In some embodiments, the IL15 constructs of the invention may be placed under the transcriptional control of the CMV promoter (SEQ. ID NO. 5411), an EF1a promoter (SEQ. ID NO. 5412 or SEQ. ID NO. 5413) or a PGK promoter (SEQ. ID NO. 5414). Any portion of IL15 that retains one or more functions of full length or mature IL15 may be useful in the present invention. Such functions include the promotion of NK cell survival, regulation of NK cell and T cell activation and proliferation as well as the support of NK cell development from hematopoietic stem cells. In some aspects, the DD-IL15 comprises the amino acid sequences listed in Table 26. The amino acid sequences in Table 26 may comprise a stop codon which is denoted in the table with a "*" at the end of the amino acid sequence.

TABLE 26

IL15 constructs

| Description | Pro-<br>moter | Amino acid sequence | Amino<br>Acid SEQ<br>ID NO | Nucleic<br>Acid SEQ<br>ID NO/<br>Sequence |
|---|---|---|---|---|
| IL2 signal<br>sequence | — | MYRMQLLSCIALSLALVTNS | 2801 | 5415-5418 |
| IgE leader | — | MDWTWILFLVAAATRVHS | 2802 | 1878, 1879,<br>5419-5421 |
| Linker | — | EFSTEF | 2803 | 5422-5423 |
| Linker | — | GGSGG | 2804 | 5424-5428 |
| HA Tag | — | YPYDVPDYA | 2805 | 5429-5430 |
| BamHI | — | GS | — | GGATCC |
| P2A<br>Cleavable<br>Peptide | — | GATNFSLLKQAGDVEENPGP | 2806 | 5431 |
| mCherry<br>(M1L) | — | LSKGEEDNMAIIKEFMRFKVHMEGSVNG<br>HEFEIEGEGEGRPYEGTQTAKLKVTKGG<br>PLPFAWDILSPQFMYGSKAYVKHPADIP<br>DYLKLSFPEGFKWERVMNFEDGGVVTV<br>TQDSSLQDGEFIYKVKLRGTNFPSDGPV<br>MQKKTMGWEASSERMYPEDGALKGEIK<br>QRLKLKDGGHYDAEVKTTYKAKKPVQL<br>PGAYNVNIKLDITSHNEDYTIVEQYERAE<br>GRHSTGGMDELYK | 2807 | 5432 |

TABLE 26-continued

| | | IL15 constructs | | |
|---|---|---|---|---|
| Description | Promoter | Amino acid sequence | Amino Acid SEQ ID NO | Nucleic Acid SEQ ID NO/ Sequence |
| IL15 | — | NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTS* | 718 | 5434-5436 (each include the stop codon at the end), 5437-5439 |
| ecDHFR (Amino acid 2-159 of WT; R12Y, Y100I) | — | ISLIAALAVDYVIGMENAMPWNLPADLA WFKRNTLNKPVIMGRHTWESIGRPLPGR KNIILSSQPGTDDRVTWVKSVDEAIAAC GDVPEIMVIGGGRVIEQFLPKAQKLYLT HIDAEVEGDTHFPDYEPDDWESVFSEFH DADAQNSHSYCFEILERR* | 2808 | 5440-5442 |
| hDHFR (Amino acid 2-187 of WT) (Y122I) | — | VGSLNCIVAVSQNMGIGKNGDLPWPPLR NEFRYFQRMTTTSSVEGKQNLVIMGKKT WFSIPEKNRPLKGRINLVLSRELKEPPQG AHFLSRSLDDALKLTEQPELANKVDMV WIVGGSSVIKEAMNHPGHLKLFVTRIMQ DFESDTFFPEIDLEKYKLLPEYPGVLSDV QEEKGIKYKFEVYEKND | 2809 | 5443 |
| OT-IL15-001 (IL2 signal sequence-IL15-stop) | CMV | MYRMQLLSCIALSLALVTNSNWVNVISD LKKIEDLIQSMHIDATLYTESDVHPSCKV TAMKCFLLELQVISLESGDASIHDTVENL IILANNSLSSNGNVTESGCKECEELEEKNI KEFLQSFVHIVQMFINTS* | 2810 | 5444 |
| OT-IL15-002 (IL2 signal sequence-linker[EFST EF (SEQ ID NO: 3086)]-ecDHFR (amino acid 2-159 of WT, R12Y, 100I)-linker [GGSGG (SEQ ID NO: 2729)]-IL15-stop) | CMV | MYRMQLLSCIALSLALVTNSEFSTEFISLI AALAVDYVIGMENAMPWNLPADLAWF KRNTLNKPVIMGRHTWESIGRPLPGRKN IILSSQPGTDDRVTWVKSVDEAIAACGD VPEIMVIGGGRVIEQFLPKAQKLYLTHID AEVEGDTHFPDYEPDDWESVFSEFHDAD AQNSHSYCFEILERRGGSGGNWVNVISD LKKIEDLIQSMHIDATLYTESDVHPSCKV TAMKCFLLELQVISLESGDASIHDTVENL IILANNSLSSNGNVTESGCKECEELEEKNI KEFLQSFVHIVQMFINTS* | 2811 | 5445 |
| OT-IL15-062 (IgE leader-HA Tag-IL15-BamHI (GS)-stop) | EF1a | MDWTWILFLVAAATRVHSYPYDVPDYA NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSGS* | 2812 | 5446 |
| OT-IL15-132 (IgE leader-IL15-BamHI (GS)-P2A cleavable peptide-mCherry (M1L)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSGSGATNFSLLKQ AGDVEENPGPLSKGEEDNMAIIKEFMRF KVHMEGSVNGHEFEIEGEGEGRPYEGTQ TAKLKVTKGGPLPFAWDILSPQFMYGSK AYVKHPADIPDYLKLSFPEGFKWERVM NFEDGGVVTVTQDSSLQDGEFIYKVKLR GTNFPSDGPVMQKKTMGWEASSERMYP EDGALKGEIKQRLKLKDGGHYDAEVKT TYKAKKPVQLPGAYNVNIKLDITSHNED YTIVEQYERAEGRHSTGGMDELYK* | 2813 | 5447 |

TABLE 26-continued

IL15 constructs

| Description | Promoter | Amino acid sequence | Amino Acid SEQ ID NO | Nucleic Acid SEQ ID NO/ Sequence |
|---|---|---|---|---|
| OT-IL15-134 (IgE leader-IL15-Linker (GS-hDHFR (WT 2-187, Y122I)-BamHI (GS)-P2A cleavable peptide-mCherry (M1L)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSGSVGSLNCIVAV SQNMGIGKNGDLPWPPLRNEFRYFQRM TTTSSVEGKQNLVIMGKKTWFSIPEKNR PLKGRINLVLSRELKEPPQGAHFLSRSLD DALKLTEQPELANKVDMVWIVGGSSVIK EAMNHPGHLKLFVTRIMQDFESDTFFPEI DLEKYKLLPEYPGVLSDVQEEKGIKYKF EVYEKNDGSGATNFSLLKQAGDVEENP GPLSKGEEDNMAIIKEFMRFKVHMEGSV NGHEFEIEGEGEGRPYEGTQTAKLKVTK GGPLPFAWDILSPQFMYGSKAYVKHPAD IPDYLKLSFPEGFKWERVMNFEDGGVVT VTQDSSLQDGEFIYKVKLRGTNFPSDGP VMQKKTMGWEASSERMYPEDGALKGEI KQRLKLKDGGHYDAEVKTTYKAKKPV QLPGAYNVNIKLDITSHNEDYTIVEQYER AEGRHSTGGMDELYK* | 2814 | 5448 |

In some instances, whole or a portion of the IL15 is linked to the whole or a portion of one or more transmembrane proteins. In some embodiments, the transmembrane domain of the present invention may be selected from the group consisting of a CD8a transmembrane domain, a CD4 transmembrane domain, a CD 28 transmembrane domain, a CTLA-4 transmembrane domain, a PD-1 transmembrane domain, and a human Ig$_{G4}$ Fc region. As non-limiting examples, the transmembrane domain may be a CTLA-4 transmembrane domain comprising the amino acid sequences of SEQ ID NOs. 1-5 of International Patent Publication NO. WO2014100385; and a PD-1 transmembrane domain comprising the amino acid sequences of SEQ ID NOs. 6-8 of International Patent Publication NO. WO2014100385; the contents of each of which are incorporated herein by reference in their entirety.

In some embodiments, the payloads of the present invention may comprise an optional hinge region (also called spacer). A hinge sequence is a short sequence of amino acids that facilitates flexibility of the extracellular targeting domain that moves the target binding domain away from the effector cell surface to enable proper cell/cell contact, target binding and effector cell activation (Patel et al., Gene Therapy, 1999; 6: 412-419). The hinge sequence can be any suitable sequence derived or obtained from any suitable molecule. The hinge sequence may be derived from all or part of an immunoglobulin (e.g., IgG1, IgG2, IgG3, IgG4) hinge region, i.e., the sequence that falls between the CH1 and CH2 domains of an immunoglobulin, e.g., an IgG4 Fc hinge, the extracellular regions of type 1 membrane proteins such as CD8a CD4, CD28 and CD7, which may be a wild type sequence or a derivative. Some hinge regions include an immunoglobulin CH3 domain or both a CH3 domain and a CH2 domain. In certain embodiments, the hinge region may be modified from an IgG1, IgG2, IgG3, or IgG4 that includes one or more amino acid residues, for example, 1, 2, 3, 4 or 5 residues, substituted with an amino acid residue different from that present in an unmodified hinge.

In some embodiments, transmembrane domains may be selected from any of those described in Table 15.

Hinge region sequences useful in the present invention are provided in Table 16.

Hinge and transmembrane region sequences useful in the present invention are provided in Table 17.

In some embodiments, the payloads of the present invention may comprise one or more linkers. The linker may be between 1-30 amino acids long. In this regard, the linker may be 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acids in length. In other embodiments, the linker may be flexible.

The effector modules containing DD-IL15 may be designed to be secreted (using e.g. IL2 signal sequence) or membrane bound (using e.g. IgE or CD8a signal sequence).

A unique feature of IL15 mediated activation is the mechanism of trans-presentation in which IL15 is presented as a complex with the alpha subunit of IL15 receptor (IL15Ra) that binds to and activates membrane bound IL15 beta/gamma receptor, either on the same cell or a different cell. The IL15/IL15Ra complex is more effective in activating IL 15 signaling, than IL15 by itself. Thus, in some embodiments, the effector module of the invention may include a DD-IL15/IL15Ra fusion polypeptide. In some embodiments, the payload of the invention may be a whole or a portion of IL15 fused to the whole or a portion of the IL15Ra. Any portion of IL15 and IL15Ra that retains one or more functions of full length or mature IL15 or IL15Ra respectively may be useful in the present invention. Such functions include the promotion of NK cell survival, regulation of NK cell and T cell activation and proliferation as well as the support of NK cell development from hematopoietic stem cells. In one embodiment, the payload may be IL15/IL 15Ra fusion polypeptide described in US Patent Publication NO.: US20160158285A1 (the contents of which are incorporated herein by reference in their entirety). The IL15 receptor alpha comprises an extracellular domain called the sushi domain which contains most of the structural elements necessary for binding to IL15. Thus, in some embodiments, payload may include IL15Ra sushi domain. As a non-limiting example, the IL15Ra sushi domain may comprise the amino acid sequence of SEQ. ID NO. 14 of US20090238791A1 (the contents of which are incorporated herein by reference in their entirety). In one embodiment, the payload of the invention maybe the IL15 fused to IL15Ra sushi domain fusion polypeptide described in US Patent Publication NO. US20090238791A1. A portion of IL15Ra useful in the invention may include 31-205 amino acids or 31-95 amino acids of the human IL15Ra (Uniprot ID: Q13261). Table 27 provides IL15Ra variants useful in the invention. In some embodiments, payload may be the IL15/IL15Ra sushi domain fusion polypeptide described in US Patent Publication NO.: US20090238791A1 (the contents of which are incorporated herein by reference in their entirety).

TABLE 27

IL15Ra variants

| Description | Sequence | Amino acid SEQ ID |
|---|---|---|
| IL15Ra Isoform 1 (NCBI Reference No. NP_002180.1) | MAPRRARGCRTLGLPALLLLLLRPPATRGITCPPPMSVEH ADIWVKSYSLYSRERYICNSGFKRKAGTSSLTECVLNKAT NVAHWTTPSLKCIRDPALVHQRPAPPSTVTTAGVTPQPES LSPSGKEPAASSPSSNNTAATTAAIVPGSQLMPSKSPSTGT TEISSHESSHGTPSQTTAKNWELTASASHQPPGVYPQGHS DTTVAISTSTVLLCGLSAVSLLACYLKSRQTPPLASVEMEA MEALPVTWGTSSRDEDLENCSHHL | 719 |
| IL15Ra Isoform 2 (NCBI reference No. NP_751950.2) | MAPRRARGCRTLGLPALLLLLLRPPATRGITCPPPMSVEH ADIWVKSYSLYSRERYICNSGFKRKAGTSSLTECVLNKAT NVAHWTTPSLKCIKPAASSPSSNNTAATTAAIVPGSQLMP SKSPSTGTTEISSHESSHGTPSQTTAKNWELTASASHQPPG VYPQGHSDTTVAISTSTVLLCGLSAVSLLACYLKSRQTPPL ASVEMEAMEALPVTWGTSSRDEDLENCSHHL | 720 |
| IL15Ra Isoform 3 (NCBI Reference No. NP_001230468.1) | MSVEHADIWVKSYSLYSRERYICNSGFKRKAGTSSLTECV LNKATNVAHWTTPSLKCIRDPALVHQRPAPPSTVTTAGVT PQPESLSPSGKEPAASSPSSNNTAATTAAIVPGSQLMPSKSP STGTTEISSHESSHGTPSQTTAKNWELTASASHQPPGVYPQ GHSDTTVAISTSTVLLCGLSAVSLLACYLKSRQTPPLASVE MEAMEALPVTWGTSSRDEDLENCSHHL | 721 |
| IL15Ra Isoform 4 (NCBI Reference No. NP_001243694.1) | MRLAGRQVPEQRSPPPPGLGSARPGSPAVSCGAAAMAPR RARGCRTLGLPALLLLLLRPPATRDARDRLAVLAGRSRI SESFNHEVQTHEACVRLRTMENCPQCHHHRTSRQQAGIT CPPPMSVEHADIWVKSYSLYSRERYICNSGFKRKAGTSSL TECVLNKATNVAHWTTPSLKCIRDPALVHQRPAPPSTVTT AGVTPQPESLSPSGKEPAASSPSSNNTAATTAAIVPGSQLM PSKSPSTGTTEISSHESSHGTPSQTTAKNWELTASASHQPP GVYPQGHSDTTVAISTSTVLLCGLSAVSLLACYLKSRQTPP LASVEMEAMEALPVTWGTSSRDEDLENCSHHL | 722 |
| IL15Ra sushi domain | CPPPMSVEHADIWVKSYSLYSRERYICNSGFKRKAGTSSL TECVLNKATNVAHWTTPSLKC | 723 |
| IL15Ra (without signal sequence) | ITCPPPMSVEHADIWVKSYSLYSRERYICNSGFKRKAGTSS LTECVLNKATNVAHWTTPSLKCIRDPALVHQRPAPPSTVT TAGVTPQPESLSPSGKEPAASSPSSNNTAATTAAIVPGSQL MPSKSPSTGTTEISSHESSHGTPSQTTAKNWELTASASHQP PGVYPQGHSDTTVAISTSTVLLCGLSAVSLLACYLKSRQTP PLASVEMEAMEALPVTWGTSSRDEDLENCSHHL | 724 |
| IL15Ra (31-205 of Uniprot ID: Q13261.1) | ITCPPPMSVEHADIWVKSYSLYSRERYICNSGFKRKAGTSS LTECVLNKATNVAHWTTPSLKCIRDPALVHQRPAPPSTVT TAGVTPQPESLSPSGKEPAASSPSSNNTAATTAAIVPGSQL MPSKSPSTGTTEISSHESSHGTPSQTTAKNWELTASASHQP PGVYPQGHSDTT | 725 |
| IL15Ra (31-95 of Q13261.1) | ITCPPPMSVEHADIWVKSYSLYSRERYICNSGFKRKAGTSS LTECVLNKATNVAHWTTPSLKCIR | 726 |

IL15/IL15Ra fusion proteins of the present invention may be linked to all or a functional portion of one or more transmembrane proteins. In some embodiments, an optional hinge region may be included. Tables 15, Table 16 and Table 17 provide various transmembrane regions, hinge and transmembrane with hinge regions that can be linked to the payloads described herein.

The whole or a portion of the membrane associated IL15 or IL15/IL15Ra fusion polypeptides of the invention may be shed into the extracellular space. Shedding as used herein refers to the release of membrane associated biomolecules from the membrane to which they are tethered. In some instances, shedding may be induced by the proteolytic cleavage. A soluble form of human IL15Ra arises from proteolytic shedding of the membrane-anchored receptor has been reported by Mortier et al (Mortier E et al. (2004). J Immunol.; 173(3):1681-8; the contents of which are incorporated by reference in their entirety). Shedding may also be induced by treatment with PMA, ionomycin, and to a lesser extent by IL1b and TNFa. In some instances, IL15 or IL15/IL15Ra fusion proteins may be modified to prevent shedding. For example, the IL15 molecule or the IL15Ra molecule may be truncated or mutated to remove presumable cleavage sites. IL15Ra has a cleavage site (PQGH-SDTT from the position 168 to 175 of SEQ. ID NO. 724) in the extracellular domain immediately distal to the transmembrane domain of the receptor, as described by Bergamaschi C et al. (2008). J Biol Chem; 283(7):4189-99; Anthony S M et al. (2015). PLoS One. 10(3): e0120274), and International Patent Application Publication Nos. WO2014066527 and WO2009002562 (the contents of each of which are incorporated herein by reference in their entirety.) Tumor necrosis factor-alpha-converting enzyme (TACE/ADAM17) has been implicated as a protease that cleaves between glycine (at the position 170 of Seq. ID NO. 724) and histidine (at the position 171 of SEQ. ID NO. 724) and generates a naturally occurring soluble form of IL15Ra. The same mechanism may be responsible for the IL15-IL15Ra shedding. Hence, the cleavage site of IL15Ra may be mutated such that cleavage by an endogenous protease is prevented. The mutation of the cleavage site may be introduced by substitution, insertion or deletion of amino acid residues. The IL15-IL15Ra fusion molecule may be also modified such that the full-length or truncated IL15-IL15Ra fusion molecule is fused to heterologous hinge domains and/or heterologous transmembrane domains. As non-limiting examples, variants of IL15Ra described in SEQ. ID NO. 5449, 5451 and 7185 can be utilized. Additionally, the length and sequence of the linkers that connect IL15 and IL15Ra may be modified.

DD-IL15/IL15Ra fusion proteins of the present invention may be expressed as a single polypeptide connected to a CAR, as described in International Patent Application Publication No. WO2016210293, the contents of which are incorporated herein by reference in their entirety. A cleavage site may be disposed between the CAR polypeptide and DD-IL15/IL15Ra fusion polypeptide. The example of a cleavage site includes 2A self-cleaving peptides, such as porcine teschovirus-1 2A (P2A), thoseaasigna virus 2A (T2A), equine rhinitis A virus 2A (E2A), foot and mouth disease virus 2A (F2A), cytoplasmic polyhedrosis virus (BmCPV 2A), and flacherie virus (BmIFV 2A) of B. mori, as described by Kim J H et al. (2011). PLoS One; 6(4): e18556 and Wang Y et al. (2015). Sci Rep; 5:16273. As a non-limiting example, the single peptide may be composed of the following components: [CAR]-[P2A cleavage site]-[IL15Ra/IL15-DD].

DD-IL15/IL15Ra fusion proteins of the present invention may be conjugated to tumor-associated antigen-recognizing antibodies or binding partners, thereby constructing bivalent-binding fusion molecules or bi-specific T-cell engagers, as described in International Patent Application Publication Nos. WO2015120187, WO2015120180, WO2016123142, WO2016123143 and WO2017000913 (the contents of each of which are incorporated herein by reference in their entirety.) The examples of tumor-associated antigen-recognizing antibodies or binding partners include a tripeptide Arg-Gly-Asp that binds to cell surface integrin receptors and thus target integrin-positive tumors, anti-TN glycopeptide antibody and anti-IL 13Ra2 antibody. The fusion molecules comprising IL15/IL15Ra fusion proteins are designed to provide a second function in conjunction with CARs to improve T cell activation and persistence.

In some aspects, DD-IL15 is trans-presented to T cells or NK cells via L 5 fusion molecules that are linked to heterologous transmembrane domains without IL15Rα, as described by Imamura M et al. (2014) Blood; 124(7):1081-1088, Garg T K et al. (2012) Haematologica; 97(9): 1348-1356, Shook D R and Campana D (2011) Tissue Antigens; 78(6):409-415, Cho D and Campana D (2009) Korean J Lab Med; 29(2):89-96, Ayello J et al. (2017) Exp Hematol; 46:38-47, Qian L et al. (2011) Plasmid; 65(3):239-45, and Weinstein-Marom H et al. (2016) J Immunother; 39(2):60-70; U.S. Pat. Nos. 7,435,596; 8,026,097; 8,399,645; 9,605, 049; and 9,623,082; US patent publication NOs. US20140328812 and US20160009784; and International patent publication NOs. WO2015174928 and WO2014005072; the contents of each of which are incorporated herein by reference in their entirety. In some embodiments, IL15 is fused to CD8alpha signal peptide and CD8alpha transmembrane, as described by International patent publication NO. WO2015174928, SEQ. ID NO. 1 and SEQ. ID NO. 2, the contents of which are incorporated herein by reference in their entirety. In some embodiments, DD-IL15 is fused to HLA-A2 transmembrane and cytoplasmic domains via a Gly-Ser linker (e.g., Gly4Ser(Gly3Ser)2 (SEQ ID NO. 2740); and 8 aa bridge from the HLA-A2 membrane-proximal part, as described by Weinstein-Marom H et al. (2016) J Immunother; 39(2):60-70, the contents of which are incorporated herein by reference in their entirety. The DD-IL15 fusion molecule may further comprise human MHC-I light chain β2-microglobulin leader peptide. In some embodiments, DD-IL15 is fused to H-2Kb transmembrane and cytoplasmic domains via a Gly-Ser linker (e.g., Gly4Ser (Gly3Ser)2; SEQ. ID NO. 2740) and 8 amino acid bridge from the H-2Kb membrane-proximal part, as described by Weinstein-Marom H et al. (2016). J Immunother; 39(2):60-70, the contents of which are incorporated herein by reference in their entirety. The DD-IL15 fusion molecule may further comprise human MHC-I light chain β2-microglobulin leader peptide.

Under inflammatory conditions, such as infections and autoimmune diseases, expression of the immunoproteasome is induced by interferon-gamma and tumor necrosis factor-alpha as described by Ferrington D A and Gregerson D S (2012) Prog Mol Biol Transl Sci; 109:75-112 and Kimura H et al. (2015) J Immunol Res; 2015:541984. The immunoproteasome is abundantly expressed in immune cells, such as antigen-presenting cells, and has more efficient proteolytic functions compared to the constitutive proteasome. For instance, while the constitutive proteasome degrades ubiquitinated proteins to maintain cell viability and homeostasis, the primary role of the immunoproteasome is to process antigens for presentation on MHC class I molecules to CD8+T lymphocytes as well as to process ubiquitinated proteins. In some embodiments, DD-IL 15/IL15Ra fusion proteins of the present invention may be designed to evade the induction of the immunoproteasome, such that the potential degradation of DD-IL15/IL15Ra fusion proteins in the presence of ligand is avoided and the expression level of IL15/IL15Ra fusion proteins is maintained. Conversely, in some embodiments, DD-IL15/IL15Ra fusion proteins of the present invention may be designed to induce the immunoproteasome in antigen-presenting cells, such that the antigen presentation on MHC class I molecules is bolstered and consequently the proliferation and activation of CD8+ T cells is augmented.

Regulated IL15/IL15Ra may be used to promote expansion, survival and potency of CD8T$_{EM}$ cell populations without impacting regulatory T cells, NK cells and TIL cells. In one embodiment, DD-IL15/IL15Ra may be utilized to enhance CD19 directed T cell therapies in B cell leukemia and lymphomas. In one aspect, IL15/IL15Ra may be used as payload of the invention to reduce the need for pre-conditioning regimens in current CAR-T treatment paradigms.

The effector modules containing DD-IL15, DD-IL15/IL15Ra and/or DD-IL15/IL15Ra sushi domain may be designed to be secreted (using e.g. IL2 signal sequence) or membrane bound (using e.g. IgE or CD8a signal sequence).

In some aspects, the DD-IL115/IL15Ra comprises the amino acid sequences provided in Table 28, 29, and 30. The amino acid sequences in Tables 28, 29 and 30 may comprise a stop codon which is denoted in the table with a "*" at the end of the amino acid sequence.

TABLE 28

DD-IL15/IL15Ra construct sequences

| Description/<br>Construct ID | Amino Acid Sequence | Amino Acid SEQ ID NO | Nucleic Acid SEQ ID NO |
|---|---|---|---|
| IgE leader | MDWTWILFLVAAATRVHS | 2794 | 5386-5388 |
| IL15RA Leader | MAPRRARGCRTLGLPALLLLLLLRPPATRG | 2815 | 5452 |
| Linker (SG3-(SG4)3-SG3-SLQ) | SGGGSGGGGSGGGGSGGGGSGGGGSGGGSLQ | 2758 | 5453-5459 |
| Linker (SG3S) | SGGGS | 2816 | 5460-5462 |
| Linker (SG3(SG4)5SG3S) | SGGGSGGGGSGGGGSGGGGSGGGGSGGGGSGGGS | 2817 | 5463 |
| Linker | SGGGSGGGGSGGGGSGGGGS | 2818 | 5464 |
| Linker | GS | — | GGTTCC |
| Linker | SG | — | AGCGGC |
| Linker | GSG | — | |
| Spacer | — | — | GGATCCGGA or GGATCCGGT 5465-5467, and TCGCGAATG or TCGCA |
| IL15 | NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS* | 2751 | 5401-5405 |
| IL15Ra | ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL* | 2752 | 5468 |
| IL15Ra (31-205 of Uniprot ID: Q13261.1) | ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT | 2822 | 5469 |
| mCherry | MSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK* | 2823 | 5470 |
| mCherry (M1L) | LSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK | 2753 | 5400 |

TABLE 28-continued

DD-IL15/IL15Ra construct sequences

| Description/ Construct ID | Amino Acid Sequence | Amino Acid SEQ ID NO | Nucleic Acid SEQ ID NO |
|---|---|---|---|
| HA Tag | YPYDVPDYA | 3080 | 5396-5398 |
| Flag | DYKDDDDK | 2824 | — |
| BamHI | GS | — | GGATCC |
| P2A Cleavable Peptide | GATNFSLLKQAGDVEENPGP | 3081 | 5399 |
| ecDHFR (Amino acid 2-159 of WT R12Y, Y100I) | ISLIAALAVDYVIGMENAMPWNLPADLAWFKRNTLN KPVIMGRHTWESIGRPLPGRKNIILSSQPGTDDRVTWV KSVDEAIAACGDVPEIMVIGGGRVIEQFLPKAQKLYLT HIDAEVEGDTHFPDYEPDDWESVFSEFHDADAQNSHS YCFEILERR* | 1174 | 5168-5173 |
| ecDHFR (Amino acid 2-159 of WT R12H, E129K) | ISLIAALAVDHVIGMENAMPWNLPADLAWFKRNTLN KPVIMGRHTWESIGRPLPGRKNIILSSQPGTDDRVTWV KSVDEAIAACGDVPEIMVIGGGRVYEQFLPKAQKLYL THIDAEVEGDTHFPDYKPDDWESVFSEFHDADAQNS HSYCFEILERR* | 1175 | 5174-5176 |
| FKBP (E31G, F36V, R71G, K105E) | GVQVETISPGDGRTFPKRGQTCVVHYTGMLGDGKKV DSSRDRNKPFKFMLGKQEVIRGWEEGVAQMSVGQG AKLTISPDYAYGATGHPGIIPPHATLVFDVELLELE* | 1177 | 5351-5357 |
| hDHFR (Amino acid 2-187 of WT; Y122I, A125F) | VGSLNCIVAVSQNMGIGKNGDLPWPPLRNEFRYFQR MTTTSSVEGKQNLVIMGKKTWFSIPEKNRPLKGRINL VLSRELKEPPQGAHFLSRSLDDALKLTEQPELANKVD MVWIVGGSSVIKEFMNHPGHLKLFVTRIMQDFESDTF FPEIDLEKYKLLPEYPGVLSDVQEEKGIKYKFEVYEKN D* | 1252 | 5474-5477 |
| hDHFR (Amino acid 2-187 of WT; Q36F, N65F, Y122I) | VGSLNCIVAVSQNMGIGKNGDLPWPPLRNEFRYFFRM TTTSSVEGKQNLVIMGKKTWFSIPEKFRPLKGRINLVL SRELKEPPQGAHFLSRSLDDALKLTEQPELANKVDMV WIVGGSSVIKEAMNHPGHLKLFVTRIMQDFESDTFFPE IDLEKYKLLPEYPGVLSDVQEEKGIKYKFEVYEKND | 1253 | 5478-5481 |
| hDHFR (Amino acid 2-187 of WT; K185E) | VGSLNCIVAVSQNMGIGKNGDLPWPPLRNEFRYFQR MTTTSSVEGKQNLVIMGKKTWFSIPEKNRPLKGRINL VLSRELKEPPQGAHFLSRSLDDALKLTEQPELANKVD MVWIVGGSSVYKEAMNHPGHLKLFVTRIMQDFESDT FFPEIDLEKYKLLPEYPGVLSDVQEEKGIKYKFEVYEE ND* | 1251 | 5482 |
| hDHFR (Amino acid 2-187 of WT; E162G, I176F) | VGSLNCIVAVSQNMGIGKNGDLPWPPLRNEFRYFQR MTTTSSVEGKQNLVIMGKKTWFSIPEKNRPLKGRINL VLSRELKEPPQGAHFLSRSLDDALKLTEQPELANKVD MVWIVGGSSVYKEAMNHPGHLKLFVTRIMQDFESDT FFPEIDLEKYKLLPGYPGVLSDVQEEKGFKYKFEVYE KND* | 1250 | 5483-5484 |
| hDHFR (Amino acid 2-187 of WT; N127Y) | VGSLNCIVAVSQNMGIGKNGDLPWPPLRNEFRYFQR MTTTSSVEGKQNLVIMGKKTWFSIPEKNRPLKGRINL VLSRELKEPPQGAHFLSRSLDDALKLTEQPELANKVD MVWIVGGSSVYKEAMYHPGHLKLFVTRIMQDFESDT FFPEIDLEKYKLLPEYPGVLSDVQEEKGIKYKFEVYEK ND | 1254 | 5485 |
| hDHFR (Amino acid 2-187 of WT; I17V) | VGSLNCIVAVSQNMGVGKNGDLPWPPLRNEFRYFQR MTTTSSVEGKQNLVIMGKKTWFSIPEKNRPLKGRINL VLSRELKEPPQGAHFLSRSLDDALKLTEQPELANKVD MVWIVGGSSVYKEAMNHPGHLKLFVTRIMQDFESDT FFPEIDLEKYKLLPEYPGVLSDVQEEKGIKYKFEVYEK ND | 1256 | 5359 |
| hDHFR (Amino acid 2-187 of WT; I17V, Y122I) | VGSLNCIVAVSQNMGVGKNGDLPWPPLRNEFRYFQR MTTTSSVEGKQNLVIMGKKTWFSIPEKNRPLKGRINL VLSRELKEPPQGAHFLSRSLDDALKLTEQPELANKVD MVWIVGGSSVIKEAMNHPGHLKLFVTRIMQDFESDTF FPEIDLEKYKLLPEYPGVLSDVQEEKGIKYKFEVYEKN D | 1244 | 5486 |

TABLE 28-continued

DD-IL15/IL15Ra construct sequences

| Description/<br>Construct ID | Amino Acid Sequence | Amino<br>Acid<br>SEQ ID NO | Nucleic<br>Acid<br>SEQ ID NO |
|---|---|---|---|
| hDHFR (Amino acid 2-187 of WT; H131R, E144G) | VGSLNCIVAVSQNMGIGKNGDLPWPPLRNEFRYFQR MTTTSSVEGKQNLVIMGKKTWFSIPEKNRPLKGRINL VLSRELKEPPQGAHFLSRSLDDALKLTEQPELANKVD MVWIVGGSSVYKEAMNHPGRLKLFVTRIMQDFGSDT FFPEIDLEKYKLLPEYPGVLSDVQEEKGIKYKFEVYEK ND | 1255 | 5487 |

TABLE 29

DD-IL15/IL15Ra constructs

| Description | Pro-moter | Amino acid sequences | Amino Acid SEQ ID NO | Nucleic Acid SEQ ID NO |
|---|---|---|---|---|
| OT-IL15-006 (IgE signal sequence; IL15; linker1 (SG3-(SG4)5-SG3 (SEQ ID NO: 3085)); IL15Ra; linker2 (GGSGG (SEQ ID NO: 2729)); ecDHFR (R12H, E129K)) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGISLI AALAVDHVIGMENAMPWNLPADLAWF KRNTLNKPVIMGRHTWESIGRPLPGRKN IILSSQPGTDDRVTWVKSVDEAIAACGD VPEIMVIGGGRVYEQFLPKAQKLYLTHI DAEVEGDTHFPDYKPDDWESVFSEFHD ADAQNSHSYCFEILERR* | 2825 | 5488 |
| OT-IL15-007 (IgE signal sequence; IL15; linker1 (SG3-(SG4)5-SG3 (SEQ ID NO: 3085)); IL15Ra; linker2 (GGSGG (SEQ ID NO: 2729)); FKBP (E31G, F36V, R71G, K105E)) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGGVQ VETISPGDGRTFPKRGQTCVVHYTGMLG DGKKVDSSRDRNKPFKFMLGKQEVIRG WEEGVAQMSVGQGAKLTISPDYAYGAT GHPGIIPPHATLVFDVELLELE* | 2826 | 5489 |
| OT-IL15-008 (IgE signal sequence-IL15-linker (SG3-(SG4)3-SG3-SLQ (SEQ ID NO: 2730))-IL15Ra-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHL* | 2827 | 5490 |

TABLE 29-continued

DD-IL15/IL15Ra constructs

| Description | Promoter | Amino acid sequences | Amino Acid SEQ ID NO | Nucleic Acid SEQ ID NO |
|---|---|---|---|---|
| OT-IL15-009 (IgE signal sequence-IL15-linker (SG3-(SG4)3-SG3-SLQ (SEQ ID NO: 2730))-IL15Ra-linker (SG)-ecDHFR (Amino acid 2-159 of WT; R12Y, Y100I)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGISLI AALAVDYVIGMENAMPWNLPADLAWF KRNTLNKPVIMGRHTWESIGRPLPGRKN IILSSQPGTDDRVTWVKSVDEAIAACGD VPEIMVIGGGRVIEQFLPKAQKLYLTHID AEVEGDTHFPDYEPDDWESVFSEFHDAD AQNSHSYCFEILERR* | 2828 | 5491 |
| OT-IL15-010 (IgE signal sequence-IL15-linker (SG3-(SG4)3-SG3-SLQ (SEQ ID NO: 2730))-IL15Ra-linker (SG)-hDHFR (Y122I, A125F)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPAL HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGVGS LNCIVAVSQNMGIGKNGDLPWPPLRNEF RYFQRMTTTSSVEGKQNLVIMGKKTWF SIPEKNRPLKGRINLVLSRELKEPPQGAH FLSRSLDDALKLTEQPELANKVDMVWIV GGSSVIKEFMNHPGHLKLFVTRIMQDFE SDTFFPEIDLEKYKLLPEYPGVLSDVQEE KGIKYKFEVYEKND* | 2829 | 5492 |
| OT-IL15-011 (IgE signal sequence-IL15-linker (SG3-(SG4)3-SG3-SLQ (SEQ ID NO: 2730))-IL15Ra; linker (SG)-hDHFR (Amino acid 2-187 of WT; Q36F, N65F, Y122I)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGVGS LNCIVAVSQNMGIGKNGDLPWPPLRNEF RYFFRMTTTSSVEGKQNLVIMGKKTWFS IPEKFRPLKGRINLVLSRELKEPPQGAHFL SRSLDDALKLTEQPELANKVDMVWIVG GSSVIKEAMNHPGHLKLFVTRIMQDFES DTFFPEIDLEKYKLLPEYPGVLSDVQEEK GIKYKFEVYEKND* | 2830 | 5493 |

TABLE 29-continued

DD-IL15/IL15Ra constructs

| Description | Promoter | Amino acid sequences | Amino Acid SEQ ID NO | Nucleic Acid SEQ ID NO |
| --- | --- | --- | --- | --- |
| OT-IL15-017 (IgE signal sequence-IL15-linker (SG3-(SG4)3-SG3-SLQ (SEQ ID NO: 2730))-IL15Ra-linker (SG)-hDHFR (Amino acid 2-187 of WT; K185E)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGVGS LNCIVAVSQNMGIGKNGDLPWPPLRNEF RYFQRMTTTSSVEGKQNLVIMGKKTWF SIPEKNRPLKGRINLVLSRELKEPPQGAH FLSRSLDDALKLTEQPELANKVDMVWIV GGSSVYKEAMNHPGHLKLFVTRIMQDF ESDTFFPEIDLEKYKLLPEYPGVLSDVQE EKGIKYKFEVYEEND* | 2831 | 5494 |
| OT-IL15-018 (IgE signal sequence-IL15-linker (SG3-(SG4)3-SG3-SLQ (SEQ ID NO: 2730))-IL15Ra-linker (SG)-hDHFR (Amino acid 2-187 of WT; E162G, I176F)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGVGS LNCIVAVSQNMGIGKNGDLPWPPLRNEF RYFQRMTTTSSVEGKQNLVIMGKKTWF SIPEKNRPLKGRINLVLSRELKEPPQGAH FLSRSLDDALKLTEQPELANKVDMVWIV GGSSVYKEAMNHPGHLKLFVTRIMQDF ESDTFFPEIDLEKYKLLPGYPGVLSDVQE EKGFKYKFEVYEKND* | 2832 | 5495 |
| OT-IL15-038 (IgE leader-IL15-Linker (SG3-(SG4)3-SG3-SLQ (SEQ ID NO: 2730))-IL15Ra-Linker (SG-hDHFR (Amino acid 2-187 of WT; N127Y)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGVGS LNCIVAVSQNMGIGKNGDLPWPPLRNEF RYFQRMTTTSSVEGKQNLVIMGKKTWF SIPEKNRPLKGRINLVLSRELKEPPQGAH FLSRSLDDALKLTEQPELANKVDMVWIV GGSSVYKEAMYHPGHLKLFVTRIMQDF ESDTFFPEIDLEKYKLLPEYPGVLSDVQE EKGIKYKFEVYEKND* | 2833 | 5496 |

TABLE 29-continued

DD-IL15/IL15Ra constructs

| Description | Promoter | Amino acid sequences | Amino Acid SEQ ID NO | Nucleic Acid SEQ ID NO |
|---|---|---|---|---|
| OT-IL15-051 (IgE leader-IL15-Linker (SG3-(SG4)3-SG3-SLQ (SEQ ID NO: 2730))-HA Tag-IL15Ra-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGGSLQYPYDVPDYAITCPP PMSVEHADIWVKSYSLYSRERYICNSGF KRKAGTSSLTECVLNKATNVAHWTTPSL KCIRDPALVHQRPAPPSTVTTAGVTPQPE SLSPSGKEPAASSPSSNNTAATTAAIVPG SQLMPSKSPSTGTTEISSHESSHGTPSQTT AKNWELTASASHQPPGVYPQGHSDTTV AISTSTVLLCGLSAVSLLACYLKSRQTPP LASVEMEAMEALPVTWGTSSRDEDLEN CSHHL* | 2834 | 5497 |
| OT-IL15-053 (IgE leader-IL15-Linker (SG3(SG4)5SG3S (SEQ ID NO: 3087))-IL15Ra-Stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGGSGGGGSGGGSITCPPP MSVEHADIWVKSYSLYSRERYICNSGFK RKAGTSSLTECVLNKATNVAHWTTPSLK CIRDPALVHQRPAPPSTVTTAGVTPQPES LSPSGKEPAASSPSSNNTAATTAAIVPGS QLMPSKSPSTGTTEISSHESSHGTPSQTTA KNWELTASASHQPPGVYPQGHSDTTVAI STSTVLLCGLSAVSLLACYLKSRQTPPLA SVEMEAMEALPVTWGTSSRDEDLENCS HHL* | 2835 | 5498 |
| OT-IL15-054 (IgE leader-IL15-Linker (SG3(SG4)3S (SEQ ID NO: 3088))-HA Tag-Linker (SG3S (SEQ ID NO: 3089))-IL15Ra-Stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSYPYDVPDYASGGGSITCPPP MSVEHADIWVKSYSLYSRERYICNSGFK RKAGTSSLTECVLNKATNVAHWTTPSLK CIRDPALVHQRPAPPSTVTTAGVTPQPES LSPSGKEPAASSPSSNNTAATTAAIVPGS QLMPSKSPSTGTTEISSHESSHGTPSQTTA KNWELTASASHQPPGVYPQGHSDTTVAI STSTVLLCGLSAVSLLACYLKSRQTPPLA SVEMEAMEALPVTWGTSSRDEDLENCS HHL* | 2836 | 5499 |
| OT-IL15-055 (IgE leader-IL15-Linker (SG)-IL15Ra-Stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGITCPPPMSVEH ADIWVKSYSLYSRERYICNSGFKRKAGT SSLTECVLNKATNVAHWTTPSLKCIRDP ALVHQRPAPPSTVTTAGVTPQPESLSPSG KEPAASSPSSNNTAATTAAIVPGSQLMPS KSPSTGTTEISSHESSHGTPSQTTAKNWE LTASASHQPPGVYPQGHSDTTVAISTSTV LLCGLSAVSLLACYLKSRQTPPLASVEM EAMEALPVTWGTSSRDEDLENCSHHL* | 2837 | 5500 |
| OT-IL15-060 (IL15Ra signal peptide-IL15-Linker(SG3-(SG4)3-SG3-SLQ (SEQ ID NO: 2730))-IL15Ra-stop) | EF1a | MAPRRARGCRTLGLPALLLLLLRPPAT RGNWVNVISDLKKIEDLIQSMHIDATLYT ESDVHPSCKVTAMKCFLLELQVISLESG DASIHDTVENLIILANNSLSSNGNVTESG CKECEELEEKNIKEFLQSFVHIVQMFINT SSGGGSGGGGSGGGGSGGGGSGGGSLQI TCPPPMSVEHADIWVKSYSLYSRERYIC NSGFKRKAGTSSLTECVLNKATNVAHW TTPSLKCIRDPALVHQRPAPPSTVTTAGV TPQPESLSPSGKEPAASSPSSNNTAATTA | 2838 | 5501 |

TABLE 29-continued

DD-IL15/IL15Ra constructs

| Description | Promoter | Amino acid sequences | Amino Acid SEQ ID NO | Nucleic Acid SEQ ID NO |
|---|---|---|---|---|
| | | AIVPGSQLMPSKSPSTGTTEISSHESSHGT PSQTTAKNWELTASASHQPPGVYPQGHS DTTVAISTSTVLLCGLSAVSLLACYLKSR QTPPLASVEMEAMEALPVTWGTSSRDE DLENCSHHL* | | |
| OT-IL15-063 (IgE leader-IL15-Linker (SG3-(SG4)3-SG3-SLQ (SEQ ID NO: 2730))-IL15Ra-BamHI (GS)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLGS* | 2839 | 5502 |
| OT-IL15-064 and OT-IL15-071 (IgE leader-IL15-Linker (SG3-(SG4)3-SG3-SLQ (SEQ ID NO: 2730))-IL15Ra-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHL* | 2827 | 5490 |
| OT-IL15-066 (IgE leader-IL15-Linker (SG3-(SG4)3-SG3-SLQ (SEQ ID NO: 2730))-IL15Ra-Linker (SG) ecDHFR (Amino acid 2-159 of WT, R12Y, Y100I)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGISLI AALAVDYVIGMENAMPWNLPADLAWF KRNTLNKPVIMGRHTWESIGRPLPGRKN IILSSQPGTDDRVTWVKSVDEAIAACGD VPEIMVIGGGRVIEQFLPKAQKLYLTHID AEVEGDTHFPDYEPDDWESVFSEFHDAD AQNSHSYCFEILERR* | 2828 | 5491 |
| OT-IL15-067 (IgE leader-IL15-Linker (SG3-(SG4)3-SG3-SLQ (SEQ ID NO: 2730))-IL15Ra-Linker (SG)-ecDHFR (Amino acid 2-159 of WT, R12Y, Y100I)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSGISLI AALAVDYVIGMENAMPWNLPADLAWF KRNTLNKPVIMGRHTWESIGRPLPGRKN | 2840 | 5503 |

TABLE 29-continued

DD-IL15/IL15Ra constructs

| Description | Promoter | Amino acid sequences | Amino Acid SEQ ID NO | Nucleic Acid SEQ ID NO |
|---|---|---|---|---|
| | | IILSSQPGTDDRVTWVKSVDEAIAACGD VPEIMVIGGGRVIEQFLPKAQKLYLTHID AEVEGDTHFPDYEPDDWESVFSEFHDAD AQNSHSYCFEILERR* | | |
| OT-IL15-070 (IL15Ra signal peptide-IL15-Linker (SG3-(SG4)3-SG3-SLQ (SEQ ID NO: 2730))-IL15Ra-stop) | EF1a | MAPRRARGCRTLGLPALLLLLLRPPAT RGNWVNVISDLKKIEDLIQSMHIDATLYT ESDVHPSCKVTAMKCFLLELQVISLESG DASIHDTVENLIILANNSLSSNGNVTESG CKECEELEEKNIKEFLQSFVHIVQMFINT SSGGGSGGGGSGGGGSGGGGSGGGSLQI TCPPPMSVEHADIWVKSYSLYSRERYIC NSGFKRKAGTSSLTECVLNKATNVAHW TTPSLKCIRDPALVHQRPAPPSTVTTAGV TPQPESLSPSGKEPAASSPSSNNTAATTA AIVPGSQLMPSKSPSTGTTEISSHESSHGT PSQTTAKNWELTASASHQPPGVYPQGHS DTTVAISTSTVLLCGLSAVSLLACYLKSR QTPPLASVEMEAMEALPVTWGTSSRDE DLENCSHHL* | 2841 | 5494 |
| OT-IL15-072 (IgE leader-IL15-Linker (SG3-(SG4)3-SG3-SLQ (SEQ ID NO: 2730))-IL15Ra-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHL* | 2827 | 5504 |
| OT-IL15-089 (IgE leader-FLAG-IL15-Linker (SG3-(SG4)3-SG3-SLQ (SEQ ID NO: 2730))-HA Tag-IL15Ra-linker (GSG)-ecDHFR (Amino acid 2-159 of WT, R12Y, Y100I)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLTECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGSGISLIAALAVDY VIGMENANPWNLPADLAWFKRNTLNKP VIMGRHTWESIGRPLPGRKNIILSSQPGT DDRVTWVKSVDEAIAACGDVPEIMVIGG GRVIEQFLPKAQKLYLTHIDAEVEGDTH FPDYEPDDWESVFSEFHDADAQNSHSYC FEILERR* | 2842 | 5505 |
| OT-IL15-109 (IgE leader-IL15-Linker (SG3-(SG4)3-SG3-SLQ (SEQ ID NO: 2730))-IL15Ra-BamHI (GS)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLGS* | 2839 | 5502 |

TABLE 29-continued

DD-IL15/IL15Ra constructs

| Description | Promoter | Amino acid sequences | Amino Acid SEQ ID NO | Nucleic Acid SEQ ID NO |
|---|---|---|---|---|
| OT-IL15-110 (IgE leader-FLAG-IL15-Linker (SG3-(SG4)3-SG3-SLQ (SEQ ID NO: 2730))-HA Tag-IL15Ra-BamHI (GS)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLTECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGS* | 2843 | 5506 |
| OT-IL15-114 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT; K185E)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLTECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGSGVGSLNCIVAV SQNMGIGKNGDLPWPPLRNEFRYFQRM TTTSSVEGKQNLVIMGKKTWFSIPEKNR PLKGRINLVLSRELKEPPQGAHFLSRSLD DALKLTEQPELANKVDMVWIVGGSSVY KEAMNHPGHLKLFVTRIMQDFESDTFFP EIDLEKYKLLPEYPGVLSDVQEEKGIKYK FEVYEEND* | 2844 | 5507 |
| OT-IL15-115 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT; E162G, I176F)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLIECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGSGVGSLNCIVAV SQNMGIGKNGDLPWPPLRNEFRYFQRM TTTSSVEGKQNLVIMGKKTWFSIPEKNR PLKGRINLVLSRELKEPPQGAHFLSRSLD DALKLTEQPELANKVDMVWIVGGSSVY KEAMNHPGHLKLFVTRIMQDFESDTFFP EIDLEKYKLLPGYPGVLSDVQEEKGFKY KFEVYEKND* | 2845 | 5508 |

TABLE 29-continued

DD-IL15/IL15Ra constructs

| Description | Promoter | Amino acid sequences | Amino Acid SEQ ID NO | Nucleic Acid SEQ ID NO |
|---|---|---|---|---|
| OT-IL15-116 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT; H131R, E144G)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLTECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGSGVGSLNCIVAV SQNMGIGKNGDLPWPPLRNEFRYFQRM TTTSSVEGKQNLVIMGKKTWFSIPEKNR PLKGRINLVLSRELKEPPQGAHFLSRSLD DALKLTEQPELANKVDMVWIVGGSSVY KEAMNHPGRLKLFVTRIMQDFESDTFFP EIDLEKYKLLPEYPGVLSDVQEEKGIKYK FEVYEKND* | 2846 | 5509 |
| OT-IL15-117 (IgE leader-FLAG-IL15-Linker (SG3-(SG4)3-SG3-SLQ (SEQ ID NO: 2730))-HA Tag-IL15Ra-Linker (GSG)-hDHFR(Amino acid 2-187 of WT; I17V)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLTECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGSGVGSLNCIVAV SQNMGVGKNGDLPWPPLRNEFRYFQRM TTTSSVEGKQNLVIMGKKTWFSIPEKNR PLKGRINLVLSRELKEPPQGAHFLSRSLD DALKLTEQPELANKVDMVWIVGGSSVY KEAMNHPGHLKLFVTRIMQDFESDTFFP EIDLEKYKLLPEYPGVLSDVQEEKGIKYK FEVYEKND* | 2847 | 5510 |
| OT-IL15-118 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT, N127Y)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLTECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGSGVGSLNCIVAV SQNMGIGKNGDLPWPPLRNEFRYFQRM TTTSSVEGKQNLVIMGKKTWFSIPEKNR PLKGRINLVLSRELKEPPQGAHFLSRSLD DALKLTEQPELANKVDMVWIVGGSSVY KEAMYHPGHLKLFVTRIMQDFESDTFFP EIDLEKYKLLPEYPGVLSDVQEEKGIKYK FEVYEKND* | 2848 | 5511 |

TABLE 29-continued

DD-IL15/IL15Ra constructs

| Description | Promoter | Amino acid sequences | Amino Acid SEQ ID NO | Nucleic Acid SEQ ID NO |
|---|---|---|---|---|
| OT-IL15-119 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT, I17V, Y122I)-stop) | EF1a | MDWTWILFLVAAATRVHSDYKDDDDK NWVNVISDLKKIEDLIQSMHIDATLYTES DVHPSCKVTAMKCFLLELQVISLESGDA SIHDTVENLIILANNSLSSNGNVTESGCK ECEELEEKNIKEFLQSFVHIVQMFINTSSG GGSGGGGSGGGGSGGGGSGGGSLQYPY DVPDYAITCPPPMSVEHADIWVKSYSLY SRERYICNSGFKRKAGTSSLTECVLNKAT NVAHWTTPSLKCIRDPALVHQRPAPPST VTTAGVTPQPESLSPSGKEPAASSPSSNN TAATTAAIVPGSQLMPSKSPSTGTTEISSH ESSHGTPSQTTAKNWELTASASHQPPGV YPQGHSDTTVAISTSTVLLCGLSAVSLLA CYLKSRQTPPLASVEMEAMEALPVTWG TSSRDEDLENCSHHLGSGVGSLNCIVAV SQNMGVGKNGDLPWPPLRNEFRYFQRM TTTSSVEGKQNLVIMGKKTWFSIPEKNR PLKGRINLVLSRELKEPPQGAHFLSRSLD DALKLTEQPELANKVDMVWIVGGSSVIK EAMNHPGHLKLFVTRIMQDFESDTFFPEI DLEKYKLLPEYPGVLSDVQEEKGIKYKF EVYEKND* | 2849 | 5512 |
| OT-IL15-128 (IgE leader-IL15-Linker (SG3-(SG4)3-SG3-SLQ (SEQ ID NO: 2730))-IL15Ra-Spacer-Flagx3-Spacer-BamHI (GS)-P2A cleavable peptide-mCherry (M1L)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLSRMD YKDDDDKDYKDDDDKDYKDDDDKSRG SGATNFSLLKQAGDVEENPGPLSKGEED NMAIIKEFMRFKVHMEGSVNGHEFEIEG EGEGRPYEGTQTAKLKVTKGGPLPFAW DILSPQFMYGSKAYVKHPADIPDYLKLSF PEGFKWERVMNFEDGGVVTVTQDSSLQ DGEFIYKVKLRGTNFPSDGPVMQKKTM GWEASSERMYPEDGALKGEIKQRLKLK DGGHYDAEVKTTYKAKKPVQLPGAYN VNIKLDITSHNEDYTIVEQYERAEGRHST GGMDELYK* | 2850 | 5513 |
| OT-IL15-129 (IgE leader-IL15-Linker (SG3-(SG4)3-SG3-SLQ (SEQ ID NO: 2730))-1L15Ra-BamHI (GS)-P2A cleavable peptide-mCherry (M1L)-stop) | EF1a | MDWTWILFLVAAATRVHSNWVNVISDL KKIEDLIQSMHIDATLYTESDVHPSCKVT AMKCFLLELQVISLESGDASIHDTVENLII LANNSLSSNGNVTESGCKECEELEEKNIK EFLQSFVHIVQMFINTSSGGGSGGGGSGG GGSGGGGSGGGSLQITCPPPMSVEHADI WVKSYSLYSRERYICNSGFKRKAGTSSL TECVLNKATNVAHWTTPSLKCIRDPALV HQRPAPPSTVTTAGVTPQPESLSPSGKEP AASSPSSNNTAATTAAIVPGSQLMPSKSP STGTTEISSHESSHGTPSQTTAKNWELTA SASHQPPGVYPQGHSDTTVAISTSTVLLC GLSAVSLLACYLKSRQTPPLASVEMEAM EALPVTWGTSSRDEDLENCSHHLGSGAT NFSLLKQAGDVEENPGPLSKGEEDNMAI IKEFMRFKVHMEGSVNGHEFEIEGEGEG RPYEGTQTAKLKVTKGGPLPFAWDILSP QFMYGSKAYVKHPADIPDYLKLSFPEGF | 2851 | 5514 |

TABLE 29-continued

DD-IL15/IL15Ra constructs

| Description | Pro-moter | Amino acid sequences | Amino Acid SEQ ID NO | Nucleic Acid SEQ ID NO |
|---|---|---|---|---|
| | | KWERVMNFEDGGVVTVTQDSSLQDGEF IYKVKLRGTNFPSDGPVMQKKTMGWEA SSERMYPEDGALKGEIKQRLKLKDGGH YDAEVKTTYKAKKPVQLPGAYNVNIKL DITSHNEDYTIVEQYERAEGRHSTGGMD ELYK* | | |

TABLE 30

IL15/IL15Ra constructs

| Construct Description | Sequence Description | Promoter | Amino acid sequences | Amino Acid SEQ ID NO | Nucleic Acid SEQ ID NO/ Sequence |
|---|---|---|---|---|---|
| OT-IL15-122 (IgE leader-IL15-linker (GS)-hDHFR (Amino acid 2-187 of WT, Y122I)-stop-spacer-IRES-spacer-mCherry-stop) | Full construct | EF1a | MDWTWILFLVAAATRVHSN WVNVISDLKKIEDLIQSMHID ATLYTESDVHPSCKVTAMKC FLLELQVISLESGDASIHDTVE NLIILANNSLSSNGNVTESGC KECEELEEKNIKEFLQSFVHIV QMFINTSGSVGSLNCIVAVSQ NMGIGKNGDLPWPPLRNEFR YFQRMTTTSSVEGKQNLVIM GKKTWFSIPEKNRPLKGRINL VLSRELKEPPQGAHFLSRSLD DALKLTEQPELANKVDMVWI VGGSSVIKEAMNHPGHLKLF VTRIMQDFESDTFFPEIDLEKY KLLPEYPGVLSDVQEEKGIKY KFEVYEKND*SR*YDSLEIPPL SLPPP*RYWPKPLGIRPVCVC LYVIFHHIAVFWQCEGPETWP CLLDEHS*GSFPSRQRNARSV ECREGSSSSGSFLKTNNVCSD PLQAAEPPTWRQVPLRPKAT CIRYTCKGGTTPVPRCELDSC GKSQMALLKRIQQGAEGCPE GTPLYGI*SGASVHMLYMCL VEVKKTSRPPEPRGRGFPPLKN TMIIWPQP**ARARRITWPSSR SSCASRCTWRAP*TATSSRSR ARARAAPTRAPRPPS*R*PRV APCPSPGTSCPLSSCTAPRPT* STPPTSPTT*SCPSPRASSGSA* *TSRTAAW*P*PRTPPCRTASS STR*SCAAPTSPPTAP*CRRRP WAGRPPPSGCTPRTAP*RARS SRG*S*RTAATTTLRSRPPTRP RSPCSCPAPTTSTSSWTSPPTT RTTPSWNSTNAPRAATPPAA WTSCTS | 2852-2867 | 5515 |
| | IgE leader-IL15-linker (GS)-hDHFR (Amino acid 2-187 of WT, Y122I)-stop | — | MDWTWILFLVAAATRVHSN WVNVISDLKKIEDLIQSMHID ATLYTESDVHPSCKVTAMKC FLLELQVISLESGDASIHDTVE NLIILANNSLSSNGNVTESGC KECEELEEKNIKEFLQSFVHIV QMFINTSGSVGSLNCIVAVSQ NMGIGKNGDLPWPPLRNEFR YFQRMTTTSSVEGKQNLVIM GKKTWFSIPEKNRPLKGRINL VLSRELKEPPQGAHFLSRSLD DALKLTEQPELANKVDMVWI VGGSSVIKEAMNHPGHLKLF VTRIMQDFESDTFFPEIDLEKY KLLPEYPGVLSDVQEEKGIKY KFEVYEKND* | 2868 | 5516 |

TABLE 30-continued

IL15/IL15Ra constructs

| Construct Description | Sequence Description | Promoter | Amino acid sequences | Amino Acid SEQ ID NO | Nucleic Acid SEQ ID NO/ Sequence |
|---|---|---|---|---|---|
| | mCherry-stop | — | MSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK* | 2869 | 5517 |
| OT-IL15-123 and OT-IL15-127(IgE leader-IL15-BamHI (GS)-stop-spacer-IRES-spacer-mCherry-stop) | Full construct | EF1a | MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGS*NLDNTTH*RSRPSPSPPPNVTGRSRLE*GRCAFVYMLFSTILPSFGNVRARKPGPVFLTSIPRGLSPLAKGMQGLLNVVKEAVPLEAS*RQTTSVATLCRQRNPPPGDRCLCGQKPRV*DTPAKAAQPQCHVVSWIVVERVKWLSSSVFNKGLKDAQKVPHCMGSDLGPRCTCFTCV*SRLKKRLGPPNHGDVVFL*KTR**YGHNHDEQGRGG*HGHHQGVHALQGAHGGLRERPRVRDRGRGPPLRGHPDRQAEGDQGWPPALRLGHPVPSVHVRLQGLREAPRRHPRLLEAVLPRGLQVGARDELRGRRRGDRDPGLLPAGRRVHLQGEAARHQLPLRRPRNAEEDHGLGGLLRADVPRGRRPEGRDQAEAEAEGRRPLRR*GQDHLQGQEARAAARRLQRQHQVGHHLPQRGLHHRGTVRTRRGPPLHRRHGRAVQV | 2870-2879 | 5518 |
| | IgE leader-IL15-BamHI (GS)-stop | — | MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGS* | 2880 | 5519 |
| | mCherry-stop | — | MSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK* | 2881 | 5520 |

In some aspects, the DD-IL15/IL15Ra comprises the amino acid sequences provided in Table 31 with any combination of components in any order. IL15Ra may be fused to DD by the amino acid sequence SG. Examples of DD-IL15/IL15Ra are provided in Table 32 and Table 33c. The amino acid sequences in Tables 31, 32 and 33 may comprise a stop codon which is denoted in the table with a "*" at the end of the amino acid sequence.

TABLE 31

| | | Amino Acid SEQ ID | Nucleic Acid SEQ ID NO/ |
|---|---|---|---|
| Description | Amino acid sequences | NO | Sequence |
| IgE leader | MDWTWILFLVAAATRVHS | 2802 | 5419-5421 |
| IL15RA Leader | MAPRRARGCRTLGLPALLLLLLLRPPATRG | 2882 | 5521 |
| Linker (SG3-(SG4)3-SG3-SLQ) | SGGGSGGGGSGGGGSGGGGSGGGSLQ | 2883 | 5522-5526 |
| Linker (SG3S) | SGGGS | 2884 | 5527-5529 |
| Linker (SG3(SG4)5 SG3S) | SGGGSGGGGSGGGGSGGGGSGGGGSGGGGSGGGS | 2885 | 5530 |
| Linker | SGGGSGGGGSGGGGSGGGGS | 2886 | 5531 |
| Linker | GS | — | GGTTCC |
| Linker | SG | — | AGCGGC |
| Linker | GSG | — | GGATCCGGA or GGATCCGGT |
| Spacer | — | — | 5532-5534, TCGCGAATG or TCGCA |
| CD8a Hinge | TTTPAPRPPTPAPTIASQPLSLRPEACRPAAGGAVHTRG LDFACDIYIWAPLAGTCGVLLLSLVITLYC | 2887 | 5535 |
| IL15 | NWVNVISDLKKIEDLIQSMHIDATLYTESDVHPSCKVT AMKCFLLELQVISLESGDASIHDTVENLIILANNSLSSN GNV1ESGCKECEELEEKNIKEFLQSFVHIVQMFINTS* | 718 | 5434-5436 (each include the stop codon at the end), 5437-5439 |
| IL15Ra | ITCPPPMSVEHADIWVKSYSLYSRERYICNSGFKRKAG TSSLTECVLNKATNVAHWTTPSLKCIRDPALVHQRPAP PSTVTTAGVTPQPESLSPSGKEPAASSPSSNNTAATTAA IVPGSQLMPSKSPSTGTTEISSHESSHGTPSQTTAKNWE LTASASHQPPGVYPQGHSDTTVAISTSTVLLCGLSAVSL LACYLKSRQTPPLASVEMEAMEALPVTWGTSSRDEDL ENCSHHL* | 724 | 5536 (includes the stop codon at the end), 5537-5540 |
| IL15Ra (31-205 of Uniprot ID: Q13261.1) | ITCPPPMSVEHADIWVKSYSLYSRERYICNSGFKRKAG TSSLTECVLNKATNVAHWTTPSLKCIRDPALVHQRPAP PSTVTTAGVTPQPESLSPSGKEPAASSPSSNNTAATTAA IVPGSQLMPSKSPSTGTTEISSHESSHGTPSQTTAKNWE LTASASHQPPGVYPQGHSDTT | 725 | 5541 |
| mCherry | MSKGEEDNMAIIKEFMRFKVHMEGSVNGHEFEIEGEG EGRPYEGTQTAKLKVTKGGPLPFAWDILSPQFMYGSK AYVKHPADIPDYLKLSFPEGFKWERVMNFEDGGVVTV TQDSSLQDGEFIYKVKLRGTNFPSDGPVMQKKTMGWE ASSERMYPEDGALKGEIKQRLKLKDGGHYDAEVKTTY KAKKPVQLPGAYNVNIKLDITSHNEDYTIVEQYERAEG RHSTGGMDELYK* | 2888 | 5542 |
| mCherry (M1L) | LSKGEEDNMAIIKEFMRFKVHMEGSVNGHEFEIEGEGE GRPYEGTQTAKLKVTKGGPLPFAWDILSPQFMYGSKA YVKHPADIPDYLKLSFPEGFKWERVMNFEDGGVVTVT QDSSLQDGEFIYKVKLRGTNFPSDGPVMQKKTMGWEA SSERMYPEDGALKGEIKQRLKLKDGGHYDAEVKTTYK AKKPVQLPGAYNVNIKLDITSHNEDYTIVEQYERAEGR HSTGGMDELYK | 2807 | 5432 |
| HA Tag | YPYDVPDYA | 2805 | 5429-5430 |
| Flag | DYKDDDDK | 2744 | 5543 |

TABLE 31-continued

IL15/IL15Ra construct regions

| Description | Amino acid sequences | Amino Acid SEQ ID NO | Nucleic Acid SEQ ID NO/ Sequence |
|---|---|---|---|
| BamHI | GS | — | GGATCC |
| P2A Cleavable Peptide | GATNFSLLKQAGDVEENPGP | 2806 | 5431 |
| ecDHFR (Amino acid 2-159 of WT; R12Y, Y100I) | ISLIAALAVDYVIGMENAMPWNLPADLAWFKRNTLNK PVIMGRHTWESIGRPLPGRKNIILSSQPGTDDRVTWVKS VDEAIAACGDVPEIMVIGGGRVIEQFLPKAQKLYLTHID AEVEGDTHFPDYEPDDWESVFSEFHDADAQNSHSYCF EILERR* | 2808 | 5440-5442 (inlcudes stop codon) |
| ecDHFR (Amino acid 2-159 of WT; R12H, E129K) | ISLIAALAVDHVIGMENAMPWNLPADLAWFKRNTLNK PVIMGRHTWESIGRPLPGRKNIILSSQPGTDDRVTWVKS VDEAIAACGDVPEIMVIGGGRVYEQFLPKAQKLYLTHI DAEVEGDTHFPDYKPDDWESVFSEFHDADAQNSHSYC FEILERR* | 2889 | 5544 (includes stop codon), 5545 |
| FKBP (E31G, F36V, R71G, K105E) | GVQVETISPGDGRTFPKRGQTCVVHYTGMLGDGKKVD SSRDRNKPFKFMLGKQEVIRGWEEGVAQMSVGQGAK LTISPDYAYGATGHPGIIPPHATLVFDVELLELE* | 2890 | 5546-5549 (each includes stop codon) |
| hDHFR (Amino acid 2-187 of WT; Y122I, A125F) | VGSLNCIVAVSQNMGIGKNGDLPWPPLRNEFRYFQRM TTTSSVEGKQNLVIMGKKTWFSIPEKNRPLKGRINLVLS RELKEPPQGAHFLSRSLDDALKLTEQPELANKVDMVW IVGGSSVIKEFMNHPGHLKLFVTRIMQDFESDTFFPEID LEKYKLLPEYPGVLSDVQEEKGIKYKFEVYEKND* | 2891 | 5550-5552 (includes stop codon) |
| hDHFR (Amino acid 2-187 of WT; Q36F, N65F, Y122I) | VGSLNCIVAVSQNMGIGKNGDLPWPPLRNEFRYFFRM TTTSSVEGKQNLVIMGKKTWFSIPEKFRPLKGRINLVLS RELKEPPQGAHFLSRSLDDALKLTEQPELANKVDMVW IVGGSSVIKEAMNHPGHLKLFVTRIMQDFESDTFFPEID LEKYKLLPEYPGVLSDVQEEKGIKYKFEVYEKND* | 2892 | 5553-5555 (includes stop codon) |
| hDHFR (Amino acid 2-187 of WT; K185E) | VGSLNCIVAVSQNMGIGKNGDLPWPPLRNEFRYFQRM TTTSSVEGKQNLVIMGKKTWFSIPEKNRPLKGRINLVLS RELKEPPQGAHFLSRSLDDALKLTEQPELANKVDMVW IVGGSSVYKEAMNHPGHLKLFVTRIMQDFESDTFFPEID LEKYKLLPEYPGVLSDVQEEKGIKYKFEVYEEND* | 2893 | 5556 |
| hDHFR (Amino acid 2-187 of WT; E162G, I176F) | VGSLNCIVAVSQNMGIGKNGDLPWPPLRNEFRYFQRM TTTSSVEGKQNLVIMGKKTWFSIPEKNRPLKGRINLVLS RELKEPPQGAHFLSRSLDDALKLTEQPELANKVDMVW IVGGSSVYKEAMNHPGHLKLFVTRIMQDFESDTFFPEID LEKYKLLPGYPGVLSDVQEEKGFKYKFEVYEKND* | 2894 | 5557 (includes stop codon), 5558 |
| hDHFR (Amino acid 2-187 of WT; N127Y) | VGSLNCIVAVSQNMGIGKNGDLPWPPLRNEFRYFQRM TTTSSVEGKQNLVIMGKKTWFSIPEKNRPLKGRINLVLS RELKEPPQGAHFLSRSLDDALKLTEQPELANKVDMVW IVGGSSVYKEAMYHPGHLKLFVTRIMQDFESDTFFPEID LEKYKLLPEYPGVLSDVQEEKGIKYKFEVYEKND | 2895 | 5559 |
| hDHFR (Amino acid 2-187 of WT; I17V) | VGSLNCIVAVSQNMGVGKNGDLPWPPLRNEFRYFQR MTTTSSVEGKQNLVIMGKKTWFSIPEKNRPLKGRINLV LSRELKEPPQGAHFLSRSLDDALKLTEQPELANKVDMV WIVGGSSVYKEAMNHPGHLKLFVTRIMQDFESDTFFPE IDLEKYKLLPEYPGVLSDVQEEKGIKYKFEVYEKND | 2896 | 5560 |
| hDHFR (Amino acid 2-187 of WT; I17V, Y122I) | VGSLNCIVAVSQNMGVGKNGDLPWPPLRNEFRYFQR MTTTSSVEGKQNLVIMGKKTWFSIPEKNRPLKGRINLV LSRELKEPPQGAHFLSRSLDDALKLTEQPELANKVDMV WIVGGSSVIKEAMNHPGHLKLFVTRIMQDFESDTFFPEI DLEKYKLLPEYPGVLSDVQEEKGIKYKFEVYEKND | 2897 | 5561 |

TABLE 31-continued

IL15/IL15Ra construct regions

| Description | Amino acid sequences | Amino Acid SEQ ID NO | Nucleic Acid SEQ ID NO/ Sequence |
|---|---|---|---|
| hDHFR (Amino acid 2-187 of WT; H131R, E144G) | VGSLNCIVAVSQNMGIGKNGDLPWPPLRNEFRYFQRM TTTSSVEGKQNLVIMGKKTWFSIPEKNRPLKGRINLVLS RELKEPPQGAHFLSRSLDDALKLTEQPELANKVDMVW IVGGSSVYKEAMNHPGRLKLFVTRIMQDFGSDTFFPEI DLEKYKLLPEYPGVLSDVQEEKGIKYKFEVYEKND | 2898 | 5562 |

TABLE 32

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-006 (IgE signal sequence; IL15; linker1 (SG3-(SG4)5-SG3S (SEQ ID NO: 3087)); IL15Ra; linker2 (GGSGG (SEQ ID NO: 2729)); ecDHFR (R12H, E129K)) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGISLIAALAVDHVIGMENA MPWNLPADLAWFKRNTLNKPVIMGRHTWES IGRPLPGRKNIILSSQPGTDDRVTWVKSVDEAI AACGDVPEIMVIGGGRVYEQFLPKAQKLYLT HIDAEVEGDTHFPDYKPDDWESVFSEFHDAD AQNSHSYCFEILERR* | 2899 | 5563 |
| OT-IL15-007 (IgE signal sequence; IL15; linker1 (SG3-(SG4)5-SG3S (SEQ ID NO: 3087)); IL15Ra; linker2 (GGSGG (SEQ ID NO: 2729)); FKBP (E31G, F36V, R71G, K105E)) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGGVQVETISPGDGRTFPKR GQTCVVHYTGMLGDGKKVDSSRDRNKPFKF MLGKQEVIRGWEEGVAQMSVGQGAKLTISPD YAYGATGHPGIIPPHATLVFDVELLELE* | 2900 | 5564 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-008 (IgE signal sequence-IL15-linker (SG3-(SG4)3-SG3-SLQ (SEQ ID NO: 2730))-IL15Ra-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHL* | 2901 | 5565 |
| OT-IL15-009 (IgE signal sequence-IL15-linker (SG3-(SG4)3-SG3-SLQ (SEQ ID NO: 2730))-IL15Ra-linker (SG)-ecDHFR (Amino acid 2-159 of WT; R12Y, Y100I)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGISLIAALAVDYVIGMENA MPWNLPADLAWFKRNTLNKPVIMGRHTWES IGRPLPGRKNIILSSQPGTDDRVTWVKSVDEAI AACGDVPEIMVIGGGRVIEQFLPKAQKLYLTH IDAEVEGDTHFPDYEPDDWESVFSEFHDADA QNSHSYCFEILERR* | 2902 | 5566 |
| OT-IL15-010 (IgE signal sequence-IL15-linker (SG3-(SG4)3-SG3-SLQ (SEQ ID NO: 2730))-IL15Ra-linker (SG)-hDHFR (Y122I, A125F)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGVGSLNCIVAVSQNMGIG KNGDLPWPPLRNEFRYFQRMTTTSSVEGKQN LVIMGKKTWFSIPEKNRPLKGRINLVLSRELK EPPQGAHFLSRSLDDALKLTEQPELANKVDM VWIVGGSSVIKEFMNHPGHLKLFVTRIMQDFE SDTFFPEIDLEKYKLLPEYPGVLSDVQEEKGIK YKFEVYEKND* | 2903 | 5567 |
| OT-IL15-011 (IgE signal sequence-IL15-linker (SG3-(SG4)3-SG3-SLQ (SEQ ID NO: 2730))-IL15Ra; linker (SG)-hDHFR (Amino acid 2-187 of WT; Q36F, N65F, Y122I)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGVGSLNCIVAVSQNMGIG KNGDLPWPPLRNEFRYFFRMTTTSSVEGKQN LVIMGKKTWFSIPEKFRPLKGRINLVLSRELKE PPQGAHFLSRSLDDALKLTEQPELANKVDMV WIVGGSSVIKEAMNHPGHLKLFVTRIMQDFES DTFFFPEIDLEKYKLLPEYPGVLSDVQEEKGIKY KFEVYEKND* | 2904 | 5568 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-017 (IgE signal sequence-IL15-linker (SG3-(SG4)3-SG3-SLQ (SEQ ID NO: 2730))-IL15Ra-linker (SG)-hDHFR (Amino acid 2-187 of WT; K185E)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGVGSLNCIVAVSQNMGIG KNGDLPWPPLRNEFRYFQRMTTTSSVEGKQN LVIMGKKTWFSIPEKNRPLKGRINLVLSRELK EPPQGAHFLSRSLDDALKLTEQPELANKVDM VWIVGGSSVYKEAMNHPGHLKLFVTRIMQDF ESDTFFPEIDLEKYKLLPEYPGVLSDVQEEKGI KYKFEVYEEND* | 2905 | 5569 |
| OT-IL15-018 (IgE signal sequence-IL15-linker (SG3-(SG4)3-SG3-SLQ (SEQ ID NO: 2730))-IL15Ra-linker (SG)-hDHFR (Amino acid 2-187 of WT; E162G, I176F)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGVGSLNCIVAVSQNMGIG KNGDLPWPPLRNEFRYFQRMTTTSSVEGKQN LVIMGKKTWFSIPEKNRPLKGRINLVLSRELK EPPQGAHFLSRSLDDALKLTEQPELANKVDM VWIVGGSSVYKEAMNHPGHLKLFVTRIMQDF ESDTFFPEIDLEKYKLLPGYPGVLSDVQEEKG FKYKFEVYEKND* | 2906 | 5570 |
| OT-IL15-038 (IgE leader-IL15-Linker (SG3-(SG4)3-SG3-SLQ (SEQ ID NO: 2730))-IL15Ra-Linker (SG)-hDHFR (Amino acid 2-187 of WT; N127Y)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGVGSLNCIVAVSQNMGIG KNGDLPWPPLRNEFRYFQRMTTTSSVEGKQN LVIMGKKTWFSIPEKNRPLKGRINLVLSRELK EPPQGAHFLSRSLDDALKLTEQPELANKVDM VWIVGGSSVYKEAMYHPGHLKLFVTRIMQDF ESDTFFPEIDLEKYKLLPEYPGVLSDVQEEKGI KYKFEVYEKND* | 2907 | 5571 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-051 (IgE leader-IL15-Linker (SG3-(SG4)3-SG3-SLQ (SEQ ID NO: 2730))-HA Tag-IL15Ra-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQYP YDVPDYAITCPPPMSVEHADIWVKSYSLYSRE RYICNSGFKRKAGTSSLTECVLNKATNVAHW TTPSLKCIRDPALVHQRPAPPSTVTTAGVTPQP ESLSPSGKEPAASSPSSNNTAATTAAIVPGSQL MPSKSPSTGTTEISSHESSHGTPSQTTAKNWEL TASASHQPPGVYPQGHSDTTVAISTSTVLLCG LSAVSLLACYLKSRQTPPLASVEMEAMEALP VTWGTSSRDEDLENCSHHL* | 2908 | 5572 |
| OT-IL15-053 (IgE leader-IL15-Linker (SG3(SG4)5 SG3(SEQ ID NO: 3087))-IL15Ra-Stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGGSGG GGSGGGSITCPPPMSVEHADIWVKSYSLYSRE RYICNSGFKRKAGTSSLTECVLNKATNVAHW TTPSLKCIRDPALVHQRPAPPSTVTTAGVTPQP ESLSPSGKEPAASSPSSNNTAATTAAIVPGSQL MPSKSPSTGTTEISSHESSHGTPSQTTAKNWEL TASASHQPPGVYPQGHSDTTVAISTSTVLLCG LSAVSLLACYLKSRQTPPLASVEMEAMEALP VTWGTSSRDEDLENCSHHL* | 2909 | 5573 |
| OT-IL15-054 (IgE leader-IL15-Linker (SG3(SG4)3 S(SEQ ID NO: 3088))-HA Tag-Linker (SG3S (SEQ ID NO: 3089))-IL15Ra-Stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSYPYDVPDY ASGGGSITCPPPMSVEHADIWVKSYSLYSRER YICNSGFKRKAGTSSLTECVLNKATNVAHWT TPSLKCIRDPALVHQRPAPPSTVTTAGVTPQPE SLSPSGKEPAASSPSSNNTAATTAAIVPGSQLM PSKSPSTGTTEISSHESSHGTPSQTTAKNWELT ASASHQPPGVYPQGHSDTTVAISTSTVLLCGL SAVSLLACYLKSRQTPPLASVEMEAMEALPV TWGTSSRDEDLENCSHHL* | 2910 | 5574 |
| OT-IL15-055 (IgE leader-IL15-Linker (SG)-IL15Ra-Stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGITCPPPMSVEHADIWVKSYSLYSRERYI CNSGFKRKAGTSSLTECVLNKATNVAHWTTP SLKCIRDPALVHQRPAPPSTVTTAGVTPQPESL SPSGKEPAASSPSSNNTAATTAAIVPGSQLMPS KSPSTGTTEISSHESSHGTPSQTTAKNWELTAS ASHQPPGVYPQGHSDTTVAISTSTVLLCGLSA VSLLACYLKSRQTPPLASVEMEAMEALPVTW GTSSRDEDLENCSHHL* | 2911 | 5575 |
| OT-IL15-060 (IL15Ra signal peptide-IL15-Linker (SG3-(SG4)3-SG3-SLQ (SEQ ID NO: 2730))-IL15Ra-stop) | EF1a | MAPRRARGCRTLGLPALLLLLLRPPATRGN WVNVISDLKKIEDLIQSMHIDATLYTESDVHP SCKVTAMKCFLLELQVISLESGDASIHDTVEN LIILANNSLSSNGNVTESGCKECEELEEKNIKE FLQSFVHIVQMFINTSSGGGSGGGGSGGGGSG GGGSGGGSLQITCPPPMSVEHADIWVKSYSLY SRERYICNSGFKRKAGTSSLTECVLNKATNVA HWTTPSLKCIRDPALVHQRPAPPSTVTTAGVT PQPESLSPSGKEPAASSPSSNNTAATTAAIVPG SQLMPSKSPSTGTTEISSHESSHGTPSQTTAKN WELTASASHQPPGVYPQGHSDTTVAISTSTVL LCGLSAVSLLACYLKSRQTPPLASVEMEAME ALPVTWGTSSRDEDLENCSHHL* | 2912 | 5576 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-063 (IgE leader-IL15-Linker (SG3-(SG4)3-SG3-SLQ (SEQ ID NO: 2730))-IL15Ra-BamHI (GS)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLGS* | 2913 | 5577 |
| OT-IL15-064 and OT-IL15-071 (IgE leader-IL15-Linker (SG3-(SG4)3-SG3-SLQ (SEQ ID NO: 2730))-IL15Ra-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHL* | 2901 | 5565 |
| OT-IL15-066 (IgE leader-IL15-Linker (SG3-(SG4)3-SG3-SLQ (SEQ ID NO: 2730))-IL15Ra-Linker (SG) ecDHFR (Amino acid 2-159 of WT, R12Y, Y100I)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGISLIAALAVDYVIGMENA MPWNLPADLAWFKRNTLNKPVIMGRHTWES IGRPLPGRKNIILSSQPGTDDRVTWVKSVDEAI AACGDVPEIMVIGGGRVIEQFLPKAQKLYLTH IDAEVEGDTHFPDYEPDDWESVFSEFHDADA QNSHSYCFEILERR* | 2902 | 5566 |
| OT-IL15-067 (IgE leader-IL15-Linker (SG3-(SG4)3-SG3-SLQ (SEQ ID NO: 2730))-IL15Ra-Linker (SG)-ecDHFR (Amino acid 2-159 of WT, R12Y, Y100I)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSGISLIAALAVDYVIGMENA MPWNLPADLAWFKRNTLNKPVIMGRHTWES IGRPLPGRKNIILSSQPGTDDRVTWVKSVDEAI AACGDVPEIMVIGGGRVIEQFLPKAQKLYLTH IDAEVEGDTHFPDYEPDDWESVFSEFHDADA QNSHSYCFEILERR* | 2914 | 5578 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-068 (IL15Ra signal peptide-IL15-Linker (SG3-(SG4)3-SG3-SLQ (SEQ ID NO: 2730))-IL15Ra-stop) | EF1a | MAPRRARGCRTLGLPALLLLLLLRPPATRGN WVNVISDLKKIEDLIQSMHIDATLYTESDVHP SCKVTAMKCFLLELQVISLESGDASIHDTVEN LIILANNSLSSNGNVTESGCKECEELEEKNIKE FLQSFVHIVQMFINTSSGGGSGGGGSGGGGSG GGGSGGGSLQITCPPPMSVEHADIWVKSYSLY SRERYICNSGFKRKAGTSSLTECVLNKATNVA HWTTPSLKCIRDPALVHQRPAPPSTVTTAGVT PQPESLSPSGKEPAASSPSSNNTAATTAAIVPG SQLMPSKSPSTGTTEISSHESSHGTPSQTTAKN WELTASASHQPPGVYPQGHSDTTVAISTSTVL LCGLSAVSLLACYLKSRQTPPLASVEMEAME ALPVTWGTSSRDEDLENCSHHL* | 2915 | 5579 |
| OT-IL15-069 (IgE leader-IL15-BamHI (GS)-IL15Ra-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSGSITCPPPMSVEHADIWVKSYSLYSRERYI CNSGFKRKAGTSSLTECVLNKATNVAHWTTP SLKCIRDPALVHQRPAPPSTVTTAGVTPQPESL SPSGKEPAASSPSSNNTAATTAAIVPGSQLMPS KSPSTGTTEISSHESSHGTPSQTTAKNWELTAS ASHQPPGVYPQGHSDTTVAISTSTVLLCGLSA VSLLACYLKSRQTPPLASVEMEAMEALPVTW GTSSRDEDLENCSHHL* | 2916 | 5580 |
| OT-IL15-070 (IL15Ra signal peptide-IL15-Linker (SG3-(SG4)3-SG3-SLQ (SEQ ID NO: 2730))-IL15Ra-stop) | EF1a | MAPRRARGCRTLGLPALLLLLLLRPPATRGN WVNVISDLKKIEDLIQSMHIDATLYTESDVHP SCKVTAMKCFLLELQVISLESGDASIHDTVEN LIILANNSLSSNGNVTESGCKECEELEEKNIKE FLQSFVHIVQMFINTSSGGGSGGGGSGGGGSG GGGSGGGSLQITCPPPMSVEHADIWVKSYSLY SRERYICNSGFKRKAGTSSLTECVLNKATNVA HWTTPSLKCIRDPALVHQRPAPPSTVTTAGVT PQPESLSPSGKEPAASSPSSNNTAATTAAIVPG SQLMPSKSPSTGTTEISSHESSHGTPSQTTAKN WELTASASHQPPGVYPQGHSDTTVAISTSTVL LCGLSAVSLLACYLKSRQTPPLASVEMEAME ALPVTWGTSSRDEDLENCSHHL* | 2915 | 5581 |
| OT-IL15-072 (IgE leader-IL15-Linker (SG3-(SG4)3-SG3-SLQ (SEQ ID NO: 2730))-IL15Ra-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHL* | 2901 | 5582 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-089 (IgE leader-FLAG-IL15-Linker (SG3-(SG4)3-SG3-SLQ (SEQ ID NO: 2730))-HA Tag-IL15Ra-linker (GSG) ecDHFR (Amino acid 2-159 of WT, R12Y, Y100I)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGSG ISLIAALAVDYVIGMENAMPWNLPADLAWFK RNTLNKPVIMGRHTWESIGRPLPGRKNIILSSQ PGTDDRVTWVKSVDEAIAACGDVPEIMVIGG GRVIEQFLPKAQKLYLTHIDAEVEGDTHFPDY EPDDWESVFSEFHDADAQNSHSYCFEILERR* | 2917 | 5583 |
| OT-IL15-109 (IgE leader-IL15-Linker (SG3-(SG4)3-SG3-SLQ (SEQ ID NO: 2730))-IL15Ra-BamHI (GS)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLGS* | 2913 | 5577 |
| OT-IL15-110 (IgE leader-FLAG-IL15-Linker (SG3-(SG4)3-SG3-SLQ (SEQ ID NO: 2730))-HA Tag-IL15Ra-BamHI (GS)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGS* | 2918 | 5584 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-114 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT; K185E)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGSG VGSLNCIVAVSQNMGIGKNGDLPWPPLRNEF RYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEEND* | 2919 | 5585 |
| OT-IL15-115 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT; E162G, I176F)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGSG VGSLNCIVAVSQNMGIGKNGDLPWPPLRNEF RYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPGYPGVLSDVQEEKGFKYKFEVYEKND* | 2920 | 5586 |
| OT-IL15-116 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT; H131R, E144G)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGSG VGSLNCIVAVSQNMGIGKNGDLPWPPLRNEF RYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGRLKLFVTRIMQDFGSDTFFPEIDLEKY KLLPEYPGVLSDVQEEKGIKYKFEVYEKND* | 2921 | 5587 |

TABLE 32-continued

IL15/IL15Ra constructs

| Description | Promoter | Amino acid sequences | Amino Acid SEQ ID NO | Nucleic Acid SEQ ID NO/Sequence |
|---|---|---|---|---|
| OT-IL15-117 (IgE leader-FLAG-IL15-Linker (SG3-(SG4)3-SG3-SLQ (SEQ ID NO: 2730))-HA Tag-IL15Ra-Linker (GSG)-hDHFR(Amino acid 2-187 of WT; I17V)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGSG VGSLNCIVAVSQNMGVGKNGDLPWPPLRNEF RYFQRMTTTSSVEGKQNLVIMGKKTWFSIPE KNRPLKGRINLVLSRELKEPPQGAHFLSRSLD DALKLTEQPELANKVDMVWIVGGSSVYKEA MNHPGHLKLFVTRIMQDFESDTFFPEIDLEKY KLLPEYPGVLSDVQEEKGIKYKFEVYEKND* | 2922 | 5588 |
| OT-IL15-118 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT, N127Y)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGSG VGSLNCIVAVSQNMGIGKNGDLPWPPLRNEF RYFQRMTTTSSVEGKQNLVIMGKKTWFSIPE KNRPLKGRINLVLSRELKEPPQGAHFLSRSLD DALKLTEQPELANKVDMVWIVGGSSVYKEA MYHPGHLKLFVTRIMQDFESDTFFPEIDLEKY KLLPEYPGVLSDVQEEKGIKYKFEVYEKND* | 2923 | 5589 |
| OT-IL15-119 (IgE leader-FLAG-IL15-Linker (SG3-(SG4)3-SG3-SLQ (SEQ ID NO: 2730))-HA Tag-IL15Ra-Linker (GSG)-hDHFR (Amino acid 2-187 of WT, I17V, Y122I)-stop) | EF1a | MDWTWILFLVAAATRVHSDYKDDDDKNWV NVISDLKKIEDLIQSMHIDATLYTESDVHPSCK VTAMKCFLLELQVISLESGDASIHDTVENLIIL ANNSLSSNGNVTESGCKECEELEEKNIKEFLQ SFVHIVQMFINTSSGGGSGGGGSGGGGSGGG GSGGGSLQYPYDVPDYAITCPPPMSVEHADI WVKSYSLYSRERYICNSGFKRKAGTSSLTECV LNKATNVAHWTTPSLKCIRDPALVHQRPAPPS TVTTAGVTPQPESLSPSGKEPAASSPSSNNTAA TTAAIVPGSQLMPSKSPSTGTTEISSHESSHGTP SQTTAKNWELTASASHQPPGVYPQGHSDTTV AISTSTVLLCGLSAVSLLACYLKSRQTPPLASV EMEAMEALPVTWGTSSRDEDLENCSHHLGSG VGSLNCIVAVSQNMGVGKNGDLPWPPLRNEF RYFQRMTTTSSVEGKQNLVIMGKKTWFSIPE KNRPLKGRINLVLSRELKEPPQGAHFLSRSLD DALKLTEQPELANKVDMVWIVGGSSVIKAM NHPGHLKLFVTRIMQDFESDTFFPEIDLEKYK LLPEYPGVLSDVQEEKGIKYKFEVYEKND* | 2924 | 5590 |

TABLE 32-continued

IL15/IL15Ra constructs

| Description | Promoter | Amino acid sequences | Amino Acid SEQ ID NO | Nucleic Acid SEQ ID NO/ Sequence |
|---|---|---|---|---|
| OT-IL15-128 (IgE leader-IL15-Linker (SG3-(SG4)3-SG3-SLQ (SEQ ID NO: 2730))-IL15Ra-Spacer-Flagx3-Spacer-BamHI (GS)-P2A cleavable peptide-mCherry (M1L)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLSRMDYKDDDDKDYKDDDD KDYKDDDDKSRGSGATNFSLLKQAGDVEENP GPLSKGEEDNMAIIKEFMRFKVHMEGSVNGH EFEIEGEGEGRPYEGTQTAKLKVTKGGPLPFA WDILSPQFMYGSKAYVKHPADIPDYLKLSFPE GFKWERVMNFEDGGVVTVTQDSSLQDGEFIY KVKLRGTNFPSDGPVMQKKTMGWEASSERM YPEDGALKGEIKQRLKLKDGGHYDAEVKTTY KAKKPVQLPGAYNVNIKLDITSHNEDYTIVEQ YERAEGRHSTGGMDELYK* | 2925 | 5591 |
| OT-IL15-129 (IgE leader-IL15-Linker (SG3-(SG4)3-SG3-SLQ (SEQ ID NO: 2730))-IL15Ra-BamHI (GS)-P2A cleavable peptide mCherry (M1L)-stop) | EF1a | MDWTWILFLVAAATRVHSNWVNVISDLKKIE DLIQSMHIDATLYTESDVHPSCKVTAMKCFLL ELQVISLESGDASIHDTVENLIILANNSLSSNG NVTESGCKECEELEEKNIKEFLQSFVHIVQMFI NTSSGGGSGGGGSGGGGSGGGGSGGGSLQIT CPPPMSVEHADIWVKSYSLYSRERYICNSGFK RKAGTSSLTECVLNKATNVAHWTTPSLKCIR DPALVHQRPAPPSTVTTAGVTPQPESLSPSGK EPAASSPSSNNTAATTAAIVPGSQLMPSKSPST GTTEISSHESSHGTPSQTTAKNWELTASASHQ PPGVYPQGHSDTTVAISTSTVLLCGLSAVSLL ACYLKSRQTPPLASVEMEAMEALPVTWGTSS RDEDLENCSHHLGSGATNFSLLKQAGDVEEN PGPLSKGEEDNMAIIKEFMRFKVHMEGSVNG HEFEIEGEGEGRPYEGTQTAKLKVTKGGPLPF AWDILSPQFMYGSKAYVKHPADIPDYLKLSFP EGFKWERVMNFEDGGVVTVTQDSSLQDGEFI YKVKLRGTNFPSDGPVMQKKTMGWEASSER MYPEDGALKGEIKQRLKLKDGGHYDAEVKT TYKAKKPVQLPGAYNVNIKLDITSHNEDYTIV EQYERAEGRHSTGGMDELYK* | 2926 | 5592 |

TABLE 33

IL15/IL15Ra constructs

| Construct Description | Sequence Description | Promoter | Amino acid sequences | Amino Acid SEQ ID NO | Nucleic Acid SEQ ID NO/ Sequence |
|---|---|---|---|---|---|
| OT-IL15-122 (IgE leader-IL15-linker (GS)-hDHFR (Amino acid 2-187 of WT, Y122I)-stop-spacer-IRES-spacer-mCherry-stop) | Full construct | EF1a | MDWTWILFLVAAATRVHSN WVNVISDLKKIEDLIQSMHID ATLYTESDVHPSCKVTAMKC FLLELQVISLESGDASIHDTVE NLIILANNSLSSNGNVTESGC KECEELEEKNIKEFLQSFVHIV QMFINTSGSVGSLNCIVAVSQ NMGIGKNGDLPWPPLRNEFR YFQRMTTTSSVEGKQNLVIM GKKTWFSIPEKNRPLKGRINL VLSRELKEPPQGAHFLSRSLD DALKLTEQPELANKVDMVWI VGGSSVIKEAMNHPGHLKLF VTRIMQDFESDTFFPEIDLEKY KLLPEYPGVLSDVQEEKGIKY | 2927-2942 | 5593 |

TABLE 33-continued

IL15/IL15Ra constructs

| Construct Description | Sequence Description | Promoter | Amino acid sequences | Amino Acid SEQ ID NO | Nucleic Acid SEQ ID NO/ Sequence |
|---|---|---|---|---|---|
| | | | KFEVYEKND*SR*YDSLEIPPL SLPPP*RYWPKPLGIRPVCVC LYVIFHHIAVFWQCEGPETWP CLLDEHS*GSFPSRQRNARSV ECREGSSSSGSFLKTNNVCSD PLQAAEPPTWRQVPLRPKAT CIRYTCKGGTTPVPRCELDSC GKSQMALLKRIQQGAEGCPE GTPLYGI*SGASVHMLYMCL VEVKKTSRPPEPRGRGFPLKN TMIIWPQP**ARARRITWPSSR SSCASRCTWRAP*TATSSRSR ARARAAPTRAPRPPS*R*PRV APCPSPGTSCPLSSCTAPRPT* STPPTSPTT*SCPSPRASSGSA* *TSRTAAW*P*PRTPPCRTASS STR*SCAAPTSPPTAP*CRRRP WAGRPPPSGCTPRTAP*RARS SRG*S*RTAATTTLRSRPPTRP RSPCSCPAPTTSTSSWTSPPTT RTTPSWNSTNAPRAATPPAA WTSCTS | | |
| | IgE leader-IL15-linker(GS)-hDHFR (Amino acid 2-187 of WT, Y122I)-stop | — | MDWTWILFLVAAATRVHSN WVNVISDLKKIEDLIQSMHID ATLYTESDVHPSCKVTAMKC FLLELQVISLESGDASIHDTVE NLIILANNSLSSNGNVTESGC KECEELEEKNIKEFLQSFVHIV QMFINTSGSVGSLNCIVAVSQ NMGIGKNGDLPWPPLRNEFR YFQRMTTTSSVEGKQNLVIM GKKTWFSIPEKNRPLKGRINL VLSRELKEPPQGAHFLSRSLD DALKLTEQPELANKVDMVWI VGGSSVIKEAMNHPGHLKLF VTRIMQDFESDTFFPEIDLEKY KLLPEYPGVLSDVQEEKGIKY KFEVYEKND* | 2943 | 5594 |
| | mCherry-stop | — | MSKGEEDNMAIIKEFMRFKV HMEGSVNGHEFEIEGEGEGRP YEGTQTAKLKVTKGGPLPFA WDILSPQFMYGSKAYVKHPA DIPDYLKLSFPEGFKWERVM NFEDGGVVTVTQDSSLQDGE FIYKVKLRGTNFPSDGPVMQ KKTMGWEASSERMYPEDGA LKGEIKQRLKLKDGGHYDAE VKTTYKAKKPVQLPGAYNV NIKLDITSHNEDYTIVEQYER AEGRHSTGGMDELYK* | 2944 | 5595 |
| OT-IL15-123 and OT-IL15-127(IgE leader-IL15-BamHI (GS)-stop-spacer-IRES-spacer-mCherry-stop) | Full construct | EF1a | MDWTWILFLVAAATRVHSN WVNVISDLKKIEDLIQSMHID ATLYTESDVHPSCKVTAMKC FLLELQVISLESGDASIHDTVE NLIILANNSLSSNGNVTESGC KECEELEEKNIKEFLQSFVHIV QMFINTSGS*NLDNTTH*RSR PSPSPPPNVTGRSRLE*GRCAF VYMLFSTILPSFGNVRARKPG PVFLTSIPRGLSPLAKGMQGL LNVVKEAVPLEAS*RQTTSVA TLCRQRNPPPGDRCLCGQKP RV*DTPAKAAQPQCHVVSWI VVERVKWLSSSVFNKGLKDA QKVPHCMGSDLGPRCTCFTC V*SRLKKRLGPPNHGDVVFL* KTR**YGHNHDEQGRGG*HG HHQGVHALQGAHGGLRERP RVRDRGRGRGPPLRGHPDRQ AEGDQGWPPALRLGHPVPSV HVRLQGLREAPRRHPRLLEA VLPRGLQVGARDELRGRRRG | 2945-2954 | 5596 |

TABLE 33-continued

IL15/IL15Ra constructs

| Construct Description | Sequence Description | Promoter | Amino acid sequences | Amino Acid SEQ ID NO | Nucleic Acid SEQ ID NO/ Sequence |
|---|---|---|---|---|---|
| | | | DRDPGLLPAGRRVHLQGEAA RHQLPLRRPRNAEEDHGLGG LLRADVPRGRRPEGRDQAEA EAEGRRPLRR*GQDHLQGQE ARAAARRLQRQHQVGHHLP QRGLHHRGTVRTRRGPPLHR RHGRAVQV | | |
| | IgE leader-IL15-BamHI (GS)-stop | – | MDWTWILFLVAAATRVHSN WVNVISDLKKIEDLIQSMHID ATLYTESDVHPSCKVTAMKC FLLELQVISLESGDASIHDTVE NLIILANNSLSSNGNVTESGC KECEELEEKNIKEFLQSFVHIV QMFINTSGS* | 2955 | 5597 |
| | mCherry-stop | – | MSKGEEDNMAIIKEFMRFKV HMEGSVNGHEFEIEGEGEGRP YEGTQTAKLKVTKGGPLPFA WDILSPQFMYGSKAYVKHPA DIPDYLKLSFPEGFKWERVM NFEDGGVVTVTQDSSLQDGE FIYKVKLRGTNFPSDGPVMQ KKTMGWEASSERMYPEDGA LKGEIKQRLKLKDGGHYDAE VKTTYKAKKPVQLPGAYNV NIKLDITSHNEDYTIVEQYER AEGRHSTGGMDELYK* | 2944 | 5595 |

In some aspects, the DD-IL15/IL15Ra comprises the amino acid sequences provided in Table 34 with any combination of components in any order. IL15Ra may be fused to DD by the amino acid sequence SG. Examples of DD-IL15/IL15Ra are provided in Table 35 and Table 36. In some aspects, the DD-IL115/IL15Ra comprises the amino acid sequences provided in Table 6a, 6b, and 6c. The amino acid sequences in Tables 6a, 6b and 6c may comprise a stop codon which is denoted in the table with a "*" at the end of the amino acid sequence.

TABLE 34

DD-IL15/IL15Ra construct sequences

| Description | Amino acid sequences | Amino Acid SEQ ID NO | Nucleic Acid SEQ ID NO |
|---|---|---|---|

TABLE 35

DD-IL15/IL15Ra constructs

| Description | Promoter | Amino acid sequences | Amino Acid SEQ ID NO | Nucleic Acid SEQ ID NO |
|---|---|---|---|---|

TABLE 36

IL15/IL15Ra constructs

| Construct Description | Sequence Description | Promoter | Amino acid sequences | Amino Acid SEQ ID NO | Nucleic Acid SEQ ID NO/ Sequence |
|---|---|---|---|---|---|

In one embodiment, the payload of the present invention may comprise IL18. IL18 is a proinflammatory and immune regulatory cytokine that promotes IFN-γ production by T and NK cells. IL18 belongs to the IL1 family. Secreted IL18 binds to a heterodimer receptor complex, consisting of IL18Rα and β-chains and initiates signal transduction. L18 acts in concert with other cytokines to modulate immune system functions, including induction of IFN-γ production, Th1 responses, and NK cell activation in response to pathogen products. IL18 showed anti-cancer effects in several tumors. Administration of recombinant IL18 protein or L18 transgene induces melanoma or sarcoma regression through the activation of CD4+ T and/or NK cell-mediated responses (reviewed by Srivastava et al., Curr. Med. Chem., 2010, 17: 3353-3357). The combination of L18 with other cytokines, such as IL12 or co-stimulatory molecules (e.g., CD80) increases IL18 anti-tumor effects. For example, L18 and IL12A/B or CD80 genes have been integrated successfully in the genome of oncolytic viruses, with the aim to trigger synergistically T cell-mediated anti-tumor immune responses (Choi et al., Gene Ther., 2011, 18: 898-909). IL2/IL18 fusion proteins also display enhanced anti-tumor properties relative to either cytokine alone and low toxicity in preclinical models (Acres et al., Cancer Res., 2005, 65:9536-9546).

IL18 alone, or in combination of IL12 and IL15, activates NK cells. Preclinical studies have demonstrated that adoptively transferred IL12, IL15 and L18 pre-activated NK cells display enhanced effector function against established tumors in vivo (Ni et al., J Exp Med. 2012, 209: 2351-2365; and Romee et al., Blood. 2012, 120:4751-4760). Human IL12/IL15/IL18 activated NK cells also display memory-like features and secrete more IFN-γ in response to cytokines (e.g., low concentration of IL2). In one embodiment, the effector module of the present invention may be a DD-IL18 fusion polypeptide.

In one embodiment, the payload of the present invention may comprise IL21. IL21 is another pleiotropic type I cytokine that is produced mainly by T cells and natural killer T (NKT) cells. IL21 has diverse effects on a variety of cell types including but not limited to CD4$^+$ and CD8$^+$ T cells, B cells, macrophages, monocytes, and dendritic cells (DCs). The functional receptor for L21 is composed of IL21 receptor (L21R) and the common cytokine receptor gamma chain, which is also a subunit of the receptors for IL2, IL4, IL7, IL9 and IL15. Studies provide compelling evidence that IL21 is a promising immunotherapeutic agent for cancer immunotherapy. L21 promotes maturation, enhances cytotoxicity, and induces production of IFN-γ and perforin by NK cells. These effector functions inhibit the growth of B 16 melanoma (Kasaian et al., *Immunity.* 2002, 16(4):559-569; and Brady et al., *J Immunol.* 2004, 172(4):2048-2058). IL21 together with IL15 expands antigen-specific CD8$^+$ T-cell numbers and their effector function, resulting in tumor regression (Zeng et al., *J Exp Med.* 2005, 201(1):139-148). IL21 may also be used to rejuvenate multiple immune effector cells in the tumor microenvironment. IL21 may also directly induce apoptosis in certain types of lymphoma such as diffuse large B-cell lymphoma, mantle cell lymphoma, and chronic lymphocytic leukemia cells, via activation of STAT3 or STAT1 signal pathway. IL21, alone or in combination with anti-CD20 mAb (rituximab) can activate NK cell-dependent cytotoxic effects. Interestingly, discovery of the immunosuppressive actions of IL21 suggests that this cytokine is a "double-edged sword"-IL21 stimulation may lead to either the induction or suppression of immune responses. Both stimulatory and suppressive effects of IL21 must be considered when using IL21-related immunotherapeutic agents. The level of IL21 needs to be tightly controlled by regulatory elements. In one aspect, the effector module of the present invention may be a DD-IL21 fusion polypeptide.

In some embodiments, payloads of the present invention may comprise type I interferons. Type I interferons (IFNs-I) are soluble proteins important for fighting viral infection in humans. IFNs-I include IFN-alpha subtypes (IFN-α1, IFN-α1b, IFN-α1c), IFN-beta, IFN-delta subtypes (IFN-delta 1, IFN-delta 2, IFN-delta 8), IFN-gamma, IFN-kappa, and IFN-epsilon, IFN-lambda, IFN-omega, IFN-tau and IFN-zeta. IFN-α and IFN-β are the main IFN-I subtypes in immune responses. All subtypes of IFN-I signal through a unique heterodimeric receptor, interferon alpha receptor (IFNAR), composed of 2 subunits, IFNAR1 and IFNAR2. IFNR activation regulates the host response to viral infections and in adaptive immunity. Several signaling cascades can be activated by IFNR, including the Janus activated kinase-signal transducer and activation of transcription (JAK-STAT) pathway, the mitogen activated protein kinase (MAPK) pathway, the phosphoinositide 3-kinase (PI3K) pathway, the v-crk sarcoma virus CT10 oncogene homolog (avian)-like (CRKL) pathway, and NF-κB cascade. It has long been established that type I IFNs directly inhibit the proliferation of tumor cells and virus-infected cells, and increase MHC class I expression, enhancing antigen recognition. IFNs-I have also proven to be involved in immune system regulation. IFNs can either directly, through interferon receptor (IFNR), or indirectly by the induction of chemokines and cytokines, regulate the immune system. Type I IFNs enhance NK cell functions and promote survival of NK cells. Type I IFNs also affect monocytes, supporting the differentiation of monocytes into DC with high capacity for antigen presentation, and stimulate macrophage function and differentiation. Several studies also demonstrate that IFNs-I promote CD8$^+$ T cell survival and functions. In some instances, it may be desirable to tune the expression of Type I IFNs using biocircuits of the present invention to avoid immunosuppression caused by long-term treatment with IFNs.

New anticancer immunotherapies are being developed that use recombinant type I IFN proteins, type I IFN transgene, type I IFN-encoding vectors and type I IFN-expressing cells. For example, IFN-α has received approval for treatment of several neoplastic diseases, such as melanoma, RCC and multiple myeloma. Though type I IFNs are powerful tools to directly and indirectly modulate the functions of the immune system, side effects of systemic long-term treatments and lack of sufficiently high efficacy have dampened the interest of IFN-α for clinical use in oncology. It is believed that if IFN levels are tightly regulated at the malignant tissues, type I IFNs are likely more efficacious. Approaches for intermittent delivery are proposed according to the observation that intermittency at an optimized pace may help to avoid signaling desensitizing mechanisms (negative feedback mechanisms) induced by IFNs-I (i.e., because of SOCS1 induction) in the responding immune cells. In accordance with the present invention, the effector module may comprise a DD-IFN fusion polypeptide. The DD and its ligand control the expression of IFN to induce an antiviral and antitumor immune responses and in the meantime, to minimize the side effects caused by long-term exposure of IFN.

In some embodiments, payloads of the present invention may comprise members of tumor necrosis factor (TNF) superfamily. The term "TNF superfamily" as used herein refers to a group of cytokines that can induce apoptosis. Members of TNF family include TNF-alpha, TNF-beta (also known as lymphotoxin-alpha (LT-α)), lymphotoxin-beta (LT-β), CD40L(CD154), CD27L (CD70), CD30L(CD153), FASL(CD178), 4-1BBL (CD137L), OX40L, TRAIL (TNF-related apoptosis inducing ligand), APRIL (a proliferation-inducing ligand), TWEAK, TRANCE, TALL-1, GITRL, LIGHT and TNFSF1 to TNFSF20 (TNF ligand superfamily member 1 to 20). In one embodiment, the payload of the invention may be TNF-alpha. TNF-alpha can cause cytolysis of tumor cells, and induce cell proliferation differentiation as well. In one aspect, the effector module of the present invention may comprise a DD-TNF alpha fusion polypeptide.

In some embodiments, payloads of the present invention may comprise inhibitory molecules that block inhibitory cytokines. The inhibitors may be blocking antibodies specific to an inhibitory cytokine, and antagonists against an inhibitory cytokine, or the like.

In some aspects, payloads of the present invention may comprise an inhibitor of a secondary cytokine IL35. IL35 belongs to the interleukin-12 (IL12) cytokine family, and is a heterodimer composed of the IL27 β chain Ebi3 and the IL12 α chain p35. Secretion of bioactive IL35 has been described only in forkhead box protein 3 (Foxp3)$^+$ regulatory T cells (Tregs) (resting and activated Tregs). Unlike other membranes in the family, IL35 appears to function solely in an anti-inflammatory fashion by inhibiting effector T cell proliferation and perhaps other parameters (Collison et al., *Nature,* 2007, 450(7169): 566-569).

In some embodiments, payloads of the present invention may comprise inhibitors that block the transforming growth factor beta (TGF-β) subtypes (TGF-β1, TGF-β2 and TGF-β3). TGF-β is secreted by many cell types, including macrophages and is often complexed with two proteins LTBP and LAP. Serum proteinases such as plasmin catalyze the release of active TGF-β from the complex from the activated macrophages. It has been shown that an increase in expression of TGF-β correlates with the malignancy of many cancers. The immunosuppressive activity of TGF-β in the tumor microenvironment contributes to oncogenesis.

In some embodiments, payloads of the present invention may comprise inhibitors of IDO enzyme.

In some embodiments, payloads of the present invention may comprise chemokines and chemokine receptors. Chemokines are a family of secreted small cytokines, or signaling proteins that can induce directed chemotaxis in nearby responsive cells. The chemokine may be a SCY (small cytokine) selected from the group consisting of SCYA1-28 (CCL1-28), SCYB1-16 (CXCL1-16), SCYC1-2 (XCL1-2), SCYD-1 and SCYE-1; or a C chemokine selected from XCL1 and XCL2; or a CC chemokine selected from CCL1, CCL2, CCL3, CCL4, CCL5, CCL6, CCL7, CCL8, CCL9, CCL10, CCL11, CCL12, CCL13, CCL14, CCL15, CCL16, CCL17, CCL18, CCL19, CCL20, CCL21, CCL22, CCL23, CCL24, CCL25, CCL26, CCL27 and CCL28; or a CXC chemokine selected from CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16 and CXCL17; or a CX3C chemokine CX3CL1. In some aspects, the chemokine receptor may be a receptor for the C chemokines including XCR1; or a receptor for the CC chemokines including CCR1, CCR2, CCR3, CCR4, CCR5, CCR6, CCR7, CCR8, CCR9 and CCR10; or a receptor for the CXC chemokines including CXCR1, CXCR2, CXCR3, CXCR4 and CXCR5; or a CX3C chemokine receptor CX3CR1.

In some embodiments, payloads of the present invention may comprise other immunomodulators that play a critical role in immunotherapy, such as GM-CSF (Granulocyte-macrophage colony stimulating factor), erythropoietin (EPO), MIP3a, monocyte chemotactic protein (MCP)-1, intracellular adhesion molecule (ICAM), macrophage colony stimulating factor (M-CSF), Interleukin-1 receptor activating kinase (iRAK-1), lactotransferrin, and granulocyte colony stimulating factor (G-CSF).

In some embodiments, the payload of the present invention may comprise Amphiregulin. Amphiregulin (AREG) is an EGF-like growth factor which binds to the EGFR receptor and enhances CD4+ regulatory T cells (Tregs) function. AREG promotes immune suppression in the tumor environment. Thus, in some embodiment, the payloads of the present invention may comprise Amhiregulin to dampen immune response during immunotherapy.

In some embodiments, payloads of the present invention may comprise fusion proteins wherein a cytokine, chemokine and/or other soluble factor may be fused to other biological molecules such as antibodies and or ligands for a receptor. Such fusion molecules may increase the half-life of the cytokines, reduce systemic toxicity, and increase local concentration of the cytokines at the tumor site. Fusion proteins containing two or more cytokines, chemokines and or other soluble factors may be utilized to obtain synergistic therapeutic benefits. In one embodiment, payload may be a GM-CSF/IL2 fusion protein.

In one embodiment, the payloads of the present invention may be cytokines fused to TNF alpha ectodomain. Such payloads are produced as membrane associated cytokines fused to the TNF ectodomain. In one embodiment, the cytokine may be shed from the cell surface by the action of membrane associated proteases, and/or proteases in the extracellular space e.g. MMP9. Any of the cytokines described herein may be useful in the present invention.

Such cytokine-TNF scaffold constructs may be used to preserve the native sequence of the processed cytokine while preserving regulation.

In some embodiments, the present invention provides methods for tuning the expression and function of an immunotherapeutic agent by operably linking it to an SRE within the effector module. Tuning of the immunotherapeutic agent may be invitro in cells or in vivo in a subject. In one embodiment, the immunotherapeutic agent is IL15. In another embodiment, the immunotherapeutic agent is a whole or a portion of IL15 fused to the whole or a portion of IL15Ra. In some embodiments, the SRE is a DD. The immunotherapeutic agent may be stabilized by the stabilization ratio of at least 1, such as by at least 1-10, 1-20, 1-30, 1-40, 1-50, 1-60, 1-70, 1-80, 1-90, 1-100, 20-30, 20-40, 20-50, 20-60, 20-70, 20-80, 20-90, 20-95, 20-100, 30-40, 30-50, 30-60, 30-70, 30-80, 30-90, 30-95, 30-100, 40-50, 40-60, 40-70, 40-80, 40-90, 40-95, 40-100, 50-60, 50-70, 50-80, 50-90, 50-95, 50-100, 60-70, 60-80, 60-90, 60-95, 60-100, 70-80, 70-90, 70-95, 70-100, 80-90, 80-95, 80-100, 90-95, 90-100 or 95-100. In some embodiments, the DD destabilizes the immunotherapeutic agen by a destabilization ratio of at least 0, such as by at least 0.1, 0.2, 0.3, 0.4, 0.5, 0.6, 0.7, 0.8, 0.9, or at least, 0-0.1, 0-0.2, 0-0.3, 0-0.4, 0-0.5, 0-0.6, 0-0.7, 0-0.8, 0-0.9, 0.1-0.2, 0.1-0.3, 0.1-0.4, 0.1-0.5, 0.1-0.6, 0.1-0.7, 0.1-0.8, 0.1-0.9, 0.2-0.3, 0.2-0.4, 0.2-0.5, 0.2-0.6, 0.2-0.7, 0.2-0.8, 0.2-0.9, 0.3-0.4, 0.3-0.5, 0.3-0.6, 0.3-0.7, 0.3-0.8, 0.3-0.9, 0.4-0.5, 0.4-0.6, 0.4-0.7, 0.4-0.8, 0.4-0.9, 0.5-0.6, 0.5-0.7, 0.5-0.8, 0.5-0.9, 0.6-0.7, 0.6-0.8, 0.6-0.9, 0.7-0.8, 0.7-0.9 or 0.8-0.9. As used herein, the term "tune" means to adjust, balance or adapt one thing in response to a stimulus or toward a particular outcome. In one non-limiting example, the SREs and/or DDs of the present invention adjust, balance or adapt the function or structure of compositions to which they are appended, attached or associated with in response to particular stimuli and/or environments. In some embodiments, the compositions of the present invention may be used to tune the expression or function of an immunotherapeutic to less than, or equal to or greater than the expression or function achieved by a constitutively expressed construct.

In some embodiments, the present invention provides methods for tuning the expression and function of an immunotherapeutic agent by operably linking it to an SRE within the effector module. Tuning of the immunotherapeutic agent may be invitro in cells or in vivo in a subject. In one embodiment, the immunotherapeutic agent is IL12. In some embodiments, the SRE is a DD. The immunotherapeutic agent may be stabilized by the stabilization ratio of between 1 and 100. In some embodiments, the DD destabilizes the immunotherapeutic agent by a destabilization ratio of between 0 and 0.1. In one embodiment, the destabilization ration may be between 0 and 0.01. As used herein, the term "tune" means to adjust, balance or adapt one thing in response to a stimulus or toward a particular outcome. In one non-limiting example, the SREs and/or DDs of the present invention adjust, balance or adapt the function or structure of compositions to which they are appended, attached or associated with in response to particular stimuli and/or environments. In some embodiments, the compositions of the present invention may be used to tune the expression or function of the payload to match the expression of function achieved by a constitutively expressed construct.

In some embodiments, ligands that do not affect the activity of the immune cell, and/or the chimeric antigen receptor, in the absence of the SREs may be preferably selected.

In some embodiments, the IL12 levels secreted by the immune cells of the invention may approximately be comparable to the IL12 levels secreted by human myeloid dendritic cells (mDC1), when activated with TLR agonists. In one embodiment, the TLR agonist may be the combination of lipopolysaccharide administered with R848.

In some embodiments, the IFN gamma secreted by IL12 induced activation of the immune cells is at least 5 fold greater in the presence of ligand, compared to the levels in the absence of ligand.

In some embodiments, the IFN gamma secreted by IL15 induced activation of the immune cells is at least 10-fold greater in the presence of ligand, compared to the levels in the absence of ligand.

In some embodiments, regulation of IL12 provides the necessary safety switch. In some embodiments, IL12 secretion recruit and/or activates effector cells in the tumor microenvironment. In some embodiments, the IL12 regulation provides a benefit to CAR T function without causing toxicity.

In some embodiments, regulation of IL15-IL15Ra fusion proteins provides a safety switch as compared to constitutively expressed IL15-IL15Rα. In some embodiments, IL15-IL15Ra leads to better expansion, and/or persistence of CAR T cells.

In some embodiments, payloads of the invention may be cytokines, and fragments, variants, analogs and derivatives thereof, including but not limited to interleukins, tumor necrosis factors (TNFs), interferons (IFNs), TGF beta and chemokines.

In some embodiments, a cytokine may be an interleukin (IL) selected from IL1, IL1alpha (also called hematopoietin-1), IL1beta (catabolin), IL1 delta, IL1epsilon, IL1eta, IL1 zeta, interleukin-1 family member 1 to 11 (IL1F1 to IL1F11), interleukin-1 homolog 1 to 4 (IL1H1 to IL1H4), IL1 related protein 1 to 3 (IL1RP1 to IL1RP3), IL2, IL3, IL4, IL5, IL6, IL7, IL8, IL9, IL10, IL10C, IL10D, IL11, IL11a, IL11b, IL12, IL13, IL14, IL15, IL16, IL17, IL17A, Il17B, IL17C, IL17E, IL17F, Il18, IL19, IL20, IL20 like (IL20L), Il21, IL22, IL23, IL23A, IL23-p19, IL23-p40, IL24, Il25, IL26, IL27, IL28A, IL28B, IL29, IL30, IL31, IL32, IL33, IL34, IL35, IL36 alpha, IL36 beta, IL36 gamma, IL36RN, IL37, IL37a, IL37b, IL37c, IL37d, IL37e and IL38.

In certain embodiments, a cytokine may be a type I interferons (IFN) including IFN-alpha subtypes (IFN-α1, IFN-α1b, IFN-α1c), IFN-beta, IFN-delta subtypes (IFN-delta 1, IFN-delta 2, IFN-delta 8), IFN-gamma, IFN-kappa, and IFN-epsilon, IFN-lambda, IFN-omega, IFN-tau and IFN-zeta. In certain embodiments, a cytokine may be a member of tumor necrosis factor (TNF) superfamily, including TNF-alpha, TNF-beta (also known as lymphotoxin-alpha (LT-α)), lymphotoxin-beta (LT-β), CD40L(CD154), CD27L (CD70), CD30L(CD153), FASL(CD178), 4-1BBL (CD137L), OX40L, TRAIL (TNF-related apoptosis inducing ligand), APRIL (a proliferation-inducing ligand), TWEAK, TRANCE, TALL-1, GITRL, LIGHT and TNFSF1 to TNFSF20 (TNF ligand superfamily member 1 to 20).

In certain embodiments, a cytokine may be a chemokine selected from SCYA1-28 (CCL1-28), SCYB1-16 (CXCL1-16), SCYC1-2 (XCL1-2), SCYD-1, SCYE-1, XCL1, XCL2, CCL1, CCL2, CCL3, CCL4, CCL5, CCL6, CCL7, CCL8, CCL9, CCL10, CCL11, CCL12, CCL13, CCL14, CCL15, CCL16, CCL17, CCL18, CCL19, CCL20, CCL21, CCL22, CCL23, CCL24, CCL25, CCL26, CCL27, CCL28, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCL17 and CX3CL1; or a chemokine receptor selected from XCR1, CCR1, CCR2, CCR3, CCR4, CCR5, CCR6, CCR7, CCR8, CCR9, CCR10, CXCR1, CXCR2, CXCR3, CXCR4, CXCR5 and CX3CR1.

In some embodiments, the payload of the present invention may be a cytokine fused to a cytokine receptor. In one embodiment, the payload may be IL15 fused to IL15 Receptor alpha subunit. A unique feature of IL15 mediated activation is the mechanism of trans-presentation in which IL15 is presented as a complex with the alpha subunit of IL15 receptor (IL15Ra) that binds to and activates membrane bound IL15 beta/gamma receptor, either on the same cell or a different cell. The IL15/IL15Ra complex is much more effective in activating IL15 signaling, than IL15 by itself. In one embodiment, the may be a IL15/IL15Ra fusion polypeptide described in US patent publication NO. US20160158285A1 (the contents of which are incorporated herein by reference in their entirety). The IL15 receptor alpha comprises an extracellular domain called the sushi domain that is considered to contain most of the structural elements necessary for binding to IL15. Thus, in some embodiments, the payload may be the IL15/IL15Ra sushi domain fusion polypeptide described in US Patent Publication NO. US20090238791A1 (the contents of which are incorporated herein by reference in their entirety). The effector modules containing IL15/IL15Rα, and/or DD-IL15/IL15Ra sushi domain may be designed to be secreted (using e.g. IL2 signal sequence) or membrane bound (using e.g. IgE or CD8a signal sequence).

In some aspects, the DD-IL115/IL15Ra comprises the amino acid sequences described in Table 37. Nucleic acid sequences encoding the amino acid sequences are also described in Table 37. In Table 37, the amino acid sequences may comprise a stop codon at the end which is denoted in the table with a "*". The position of the mutated amino acids listed in Table 37 is relative to the wildtype human DHFR (Uniprot ID: P00374) of SEQ ID NO. 1.

TABLE 37 hDHFR-IL15/IL15Ra constructs

| Description | Amino acid sequences | Amino Acid SEQ ID NO | Nucleic Acid SEQ ID NO |
| --- | --- | --- | --- |
| IL2 signal sequence | MYRMQLLSCIALSLALVTNS | 2956 | 5598-5601 |
| IgE leader sequence | MDWTWILFLVAAATRVHS | 2957 | 5602 |

TABLE 37-continued hDHFR-IL15/IL15Ra constructs

| Description | Amino acid sequences | Amino Acid SEQ ID NO | Nucleic Acid SEQ ID NO |
| --- | --- | --- | --- |
| IL15 | NWVNVISDLKKIEDLIQSMHIDATLYTESDVHPSCKVTAMK CFLLELQVISLESGDASIHDTVENLIILANNSLSSNGNVTESGC KECEELEEKNIKEFLQSFVHIVQMFINTS* | 2958 | 5603-5606 |
| IL15Ra | ITCPPPMSVEHADIWVKSYSLYSRERYICNSGFKRKAGTSSLT ECVLNKATNVAHWTTPSLKCIRDPALVHQRPAPPSTVTTAG VTPQPESLSPSGKEPAASSPSSNNTAATTAAIVPGSQLMPSKS PSTGTTEISSHESSHGTPSQTTAKNWELTASASHQPPGVYPQ GHSDTTVAISTSTVLLCGLSAVSLLACYLKSRQTPPLASVEM EAMEALPVTWGTSSRDEDLENCSHHL | 2959 | 7679 7680 |
| Linker | SGGGSGGGGSGGGGSGGGGSGGGGSLQ | 2960 | 5607 |
| hDHFR (Amino acid 2-187 of WT) (Y122I, A125F) | VGSLNCIVAVSQNMGIGKNGDLPWPPLRNEFRYFQRMTTTS SVEGKQNLVIMGKKTWFSIPEKNRPLKGRINLVLSRELKEPP QGAHFLSRSLDDALKLTEQPELANKVDMVWIVGGSSVIKEF MNHPGHLKLFVTRIMQDFESDTFFPEIDLEKYKLLPEYPGVL SDVQEEKGIKYKFEVYEKND | 41 | 5608 |
| hDHFR (Amino acid 2-187 of WT) (Q36F, N65F, Y122I) | VGSLNCIVAVSQNMGIGKNGDLPWPPLRNEFRYFFRMTTTS SVEGKQNLVIMGKKTWFSIPEKFRPLKGRINLVLSRELKEPP QGAHFLSRSLDDALKLTEQPELANKVDMVWIVGGSSVIKEA MNHPGHLKLFVTRIMQDFESDTFFPEIDLEKYKLLPEYPGVL SDVQEEKGIKYKFEVYEKND | 56 | 5609 |
| OT-IL15-008 (IgE signal sequence; IL15; linker (SG3-(SG4)3-SG3-SLQ (SEQ ID NO: 2730)); IL15Ra; stop) | MDWTWILFLVAAATRVHSNWVNVISDLKKIEDLIQSMHIDA TLYTESDVHPSCKVTAMKCFLLELQVISLESGDASIHDTVEN LIILANNSLSSNGNVTESGCKECEELEEKNIKEFLQSFVHIVQ MFINTSSGGGSGGGGSGGGGSGGGGSGGGSLQITCPPPMSVE HADIWVKSYSLYSRERYICNSGFKRKAGTSSLTECVLNKAT NVAHWTTPSLKCIRDPALVHQRPAPPSTVTTAGVTPQPESLS PSGKEPAASSPSSNNTAATTAAIVPGSQLMPSKSPSTGTTEISS HESSHGTPSQTTAKNWELTASASHQPPGVYPQGHSDTTVAIS TSTVLLCGLSAVSLLACYLKSRQTPPLASVEMEAMEALPVT WGTSSRDEDLENCSHHL* | 2961 | 5610 |
| OT-IL15-010 (IgE signal sequence; IL15; linker (SG3-(SG4)3-SG3-SLQ (SEQ ID NO: 2730)); IL15Ra; linker (SG); hDHFR (Amino acid 2-187 of WT) (Y122I, A125F); stop) | MDWTWILFLVAAATRVHSNWVNVISDLKKIEDLIQSMHIDA TLYTESDVHPSCKVTAMKCFLLELQVISLESGDASIHDTVEN LIILANNSLSSNGNVTESGCKECEELEEKNIKEFLQSFVHIVQ MFINTSSGGGSGGGGSGGGGSGGGGSGGGSLQITCPPPMSVE HADIWVKSYSLYSRERYICNSGFKRKAGTSSLTECVLNKAT NVAHWTTPSLKCIRDPALVHQRPAPPSTVTTAGVTPQPESLS PSGKEPAASSPSSNNTAATTAAIVPGSQLMPSKSPSTGTTEISS HESSHGTPSQTTAKNWELTASASHQPPGVYPQGHSDTTVAIS TSTVLLCGLSAVSLLACYLKSRQTPPLASVEMEAMEALPVT WGTSSRDEDLENCSHHLSGVGSLNCIVAVSQNMGIGKNGDL PWPPLRNEFRYFQRMTTTSSVEGKQNLVIMGKKTWFSIPEK NRPLKGRINLVLSRELKEPPQGAHFLSRSLDDALKLTEQPEL ANKVDMVWIVGGSSVIKEFMNHPGHLKLFVTRIMQDFESDT FFPEIDLEKYKLLPEYPGVLSDVQEEKGIKYKFEVYEKND* | 2217 | 5611 |
| OT-IL15-011 (IgE signal sequence; IL15; linker (SG3-(SG4)3-SG3-SLQ (SEQ ID NO: 2730)); IL15Ra; linker (SG); hDHFR (Amino acid 2-187 of WT) (Q36F, N65F, Y122I); stop) | MDWTWILFLVAAATRVHSNWVNVISDLKKIEDLIQSMHIDA TLYTESDVHPSCKVTAMKCFLLELQVISLESGDASIHDTVEN LIILANNSLSSNGNVTESGCKECEELEEKNIKEFLQSFVHIVQ MFINTSSGGGSGGGGSGGGGSGGGGSGGGSLQITCPPPMSVE HADIWVKSYSLYSRERYICNSGFKRKAGTSSLTECVLNKAT NVAHWTTPSLKCIRDPALVHQRPAPPSTVTTAGVTPQPESLS PSGKEPAASSPSSNNTAATTAAIVPGSQLMPSKSPSTGTTEISS HESSHGTPSQTTAKNWELTASASHQPPGVYPQGHSDTTVAIS TSTVLLCGLSAVSLLACYLKSRQTPPLASVEMEAMEALPVT WGTSSRDEDLENCSHHLSGVGSLNCIVAVSQNMGIGKNGDL PWPPLRNEFRYFFRMTTTSSVEGKQNLVIMGKKTWFSIPEKF RPLKGRINLVLSRELKEPPQGAHFLSRSLDDALKLTEQPELA NKVDMVWIVGGSSVIKEAMNHPGHLKLFVTRIMQDFESDTF FPEIDLEKYKLLPEYPGVLSDVQEEKGIKYKFEVYEKND* | 2218 | 5612 |

In one aspect, the payload of the invention may be IL12 fusion. This regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer. In some embodiments, the IL12 may be a Flexi IL12, wherein both p35 and p40 subunits, are encoded by a single cDNA that produces a single chain polypeptide. In some aspects, the human DHFR-IL12 comprises the amino acid sequences described in Table 38. Nucleic acid sequences encoding the amino acid sequences are also described in Table 38. In Table 38, the amino acid sequences may comprise a stop codon at the end which is denoted in the table with a "*". The position of the mutated amino acids listed in Table 38 is relative to the wildtype human DHFR (Uniprot ID: P00374) of SEQ ID NO. 5613.

TABLE 38

DD-IL12 constructs

| Description | Amino Acid Sequence | Amino Acid SEQ ID NO | Nucleic Acid SEQ ID NO |
|---|---|---|---|
| p40 signal sequence | MCHQQLVISWFSLVFLASPLVA | 2219 | 5614-5622 |
| Linker | GGGGSGGGGSGGGGS | 2962 | 5623-5628 |
| Modified Furin | ESRRVRRNKRSK | 2963 | 5629-5631 |
| p40 | IWELKKDVYVVELDWYPDAPGEMVVLTCDTPEEDGITW TLDQSSEVLGSGKTLTIQVKEFGDAGQYTCHKGGEVLS HSLLLLHKKEDGIWSTDILKDQKEPKNKTFLRCEAKNY SGRFTCWWLTTISTDLTFSVKSSRGSSDPQGVTCGAAT LSAERVRGDNKEYEYSVECQEDSACPAAEESLPIEVMV DAVHKLKYENYTSSFFIRDIIKPDPPKNLQLKPLKNSR QVEVSWEYPDTWSTPHSYFSLTFCVQVQGKSKREKKDR VFTDKTSATVICRKNASISVRAQDRYYSSSWSEWASVP CS* | 2964 | 5632-5641 |
| p35 | RNLPVATPDPGMFPCLHHSQNLLRAVSNMLQKARQTLE FYPCTSEEIDHEDITKDKTSTVEACLPLELTKNESCLN SRETSFITNGSCLASRKTSFMMALCLSSIYEDLKMYQV EFKTMNAKLLMDPKRQIFLDQNMLAVIDELMQALNFNS ETVPQKSSLEEPDFYKTKIKLCILLHAFRIRAVTIDRV MSYLNAS* | 2965 | 5642 |
| p35 (Amino acid 5-197 of SEQ ID NO. 185) | VATPDPGMFPCLHHSQNLLRAVSNMLQKARQTLEFYPC TSEEIDHEDITKDKTSTVEACLPLELTKNESCLNSRET SFITNGSCLASRKTSFMMALCLSSIYEDLKMYQVEFKT MNAKLLMDPKRQIFLDQNMLAVIDELMQALNFNSETVP QKSSLEEPDFYKTKIKLCILLHAFRIRAVTIDRVMSYL NAS* | 2966 | 5643 |
| hDHFR(Amino acid 2-187 of WT) (Q36F, Y122I, A125F) | VGSLNCIVAVSQNMGIGKNGDLPWPPLRNEFRYFFRMT TTSSVEGKQNLVIMGKKTWFSIPEKNRPLKGRINLVLS RELKEPPQGAHFLSRSLDDALKLTEQPELANKVDMVWI VGGSSVIKEFMNHPGHLKLFVTRIMQDFESDTFFPEID LEKYKLLPEYPGVLSDVQEEKGIKYKFEVYEKND | 57 | 5644 |
| OT-IL12-006 (p40 signal sequence; p40; linker (G4S)3 (SEQ ID NO: 2731); p35) | MCHQQLVISWFSLVFLASPLVAIWELKKDVYVVELDWY PDAPGEMVVLTCDTPEEDGITWTLDQSSEVLGSGKTLT IQVKEFGDAGQYTCHKGGEVLSHSLLLLHKKEDGIWST DILKDQKEPKNKTFLRCEAKNYSGRFTCWWLTTISTDL TFSVKSSRGSSDPQGVTCGAATLSAERVRGDNKEYEYS VECQEDSACPAAEESLPIEVMVDAVHKLKYENYTSSFF IRDIIKPDPPKNLQLKPLKNSRQVEVSWEYPDTWSTPH SYFSLTFCVQVQGKSKREKKDRVFTDKTSATVICRKNA SISVRAQDRYYSSSWSEWASVPCSGGGGSGGGGSGGGG SRNLPVATPDPGMFPCLHHSQNLLRAVSNMLQKARQTL EFYPCTSEEIDHEDITKDKTSTVEACLPLELTKNESCL NSRETSFITNGSCLASRKTSFMMALCLSSIYEDLKMYQ VEFKTMNAKLLMDPKRQIFLDQNMLAVIDELMQALNFN SETVPQKSSLEEPDFYKTKIKLCILLHAFRIRAVTIDR VMSYLNAS* | 2967 | 5645 |

TABLE 38-continued

DD-IL12 constructs

| Description | Amino Acid Sequence | Amino Acid SEQ ID NO | Nucleic Acid SEQ ID NO |
|---|---|---|---|
| OT-IL12-008 (p40 signal sequence; DD-hDHFR (Amino acid 2-187 of WT) (Q36F, Y122I, A125F); furin site (ESRRVRRNKRSK (SEQ ID NO: 2734)); p40; linker (G4S)3 (SEQ ID NO: 2731); p35) | MCHQQLVISWFSLVFLASPLVAVGSLNCIVAVSQNMGI GKNGDLPWPPLRNEFRYFFRMTTTSSVEGKQNLVIMGK KTWFSIPEKNRPLKGRINLVLSRELKEPPQGAHFLSRS LDDALKLTEQPELANKVDMVWIVGGSSVIKEFMNHPGH LKLFVTRIMQDFESDTFFPEIDLEKYKLLPEYPGVLSD VQEEKGIKYKFEVYEKNDESRRVRRNKRSKIWELKKDV YVVELDWYPDAPGEMVVLTCDTPEEDGITWTLDQSSEV LGSGKTLTIQVKEFGDAGQYTCHKGGEVLSHSLLLLHK KEDGIWSTDILKDQKEPKNKTFLRCEAKNYSGRFTCWW LTTISTDLTFSVKSSRGSSDPQGVTCGAATLSAERVRG DNKEYEYSVECQEDSACPAAEESLPIEVMVDAVHKLKY ENYTSSFFIRDIIKPDPPKNLQLKPLKNSRQVEVSWEY PDTWSTPHSYFSLTFCVQVQGKSKREKKDRVFTDKTSA TVICRKNASISVRAQDRYYSSSWSEWASVPCSGGGGSG GGGSGGGGSRNLPVATPDPGMFPCLHHSQNLLRAVSNM LQKARQTLEFYPCTSEEIDHEDITKDKTSTVEACLPLE LTKNESCLNSRETSFITNGSCLASRKTSFMMALCLSSI YEDLKMYQVEFKTMNAKLLMDPKRQIFLDQNMLAVIDE LMQALNFNSETVPQKSSLEEPDFYKTKIKLCILLHAFR IRAVTIDRVMSYLNAS | 2968 | 5646 |

In some embodiments, payloads fused to the DDs of the invention may be an inhibitor of an immunosuppressive molecule such as TGF-beta and IDO.

Safety Switch

In some embodiments, payloads of the present invention may comprise SRE regulated safety switches that can eliminate adoptively transferred cells in the case of severe toxicity, thereby mitigating the adverse effects of T cell therapy. Adoptively transferred T cells in immunotherapy may attack normal cells in response to normal tissue expression of TAA. Even on-tumor target activity of adoptively transferred T cells can result in toxicities such as tumor lysis syndrome, cytokine release syndrome and the related macrophage activation syndrome. Safety switches may be utilized to eliminate inappropriately activated adoptively transferred cells by induction of apoptosis or by immunosurveillance.

In some embodiments, payloads of the present invention may comprise inducible killer/suicide genes that acts as a safety switch. The killer/suicide gene when introduced into adoptively transferred immune cells, could control their alloreactivity. The killer/suicide gene may be an apoptotic gene (e.g., any Caspase gene) which allows conditional apoptosis of the transduced cells by administration of a non-therapeutic ligand of the SRE (e.g., DD).

In some embodiments, the payloads of the present invention may be Caspase 9. In some instances, Caspase 9 may be modified to have low basal expression and lacking the Caspase recruitment domain (CARD) (SEQ ID NO. 26 and SEQ ID NO. 28 of U.S. Pat. No. 9,434,935B2; the contents of which are incorporated by reference in their entirety).

In one embodiment, the payload of the present invention is a suicide gene system, iCasp9/Chemical induced dimerization (CID) system which consists of a polypeptide derived from the Caspase9 gene fused to a drug binding domain derived from the human FK506 protein. Administration of bioinert, small molecule AP1903 (rimiducid), induces cross linking of the drug binding domains and dimerization of the fusion protein and in turn the dimerization of Caspase 9. This results in the activation of downstream effector Caspase 3 and subsequent induction of cellular apoptosis (Straathof et al., *Blood*, 2005, 105: 4247-4254; incorporated herein by reference in its entirety). Preclinical trials using CART including an iCasp9 gene have shown effective elimination of CAR T cells in vivo in mouse models and demonstrate the potential efficacy of this approach. (Budde et al, *Plos One*, 2013, 8: e82742.10.1371; Hoyos et al., *Leukemia*, 2010; 24(6): 1160-1170). In one embodiment, the payload of the invention may comprise Caspase 9. In one aspect, the effector module of the invention may be a DD-Caspase9 fusion polypeptide. The DD-Caspase 9 may comprise the amino acid sequences provided in Table 39. In Table 39, the amino acid sequences may comprise a stop codon at the 3' end which is denoted in the table with a "*". The DD-Caspase 9 may comprise the amino acid sequences provided in Table 40. The amino acid sequences in Table 40 may comprise a stop codon which is denoted in the table with a "*" at the end of the amino acid sequence

TABLE 39

DD-Caspase 9 constructs

| Description/ Construct ID | Amino acid sequence | Amino Acid SEQ ID NO. | Nucleic Acid SEQ ID NO. |
|---|---|---|---|
| Caspase 9 | MDEADRRLLRRCRLRLVEELQVDQLWDALLSRELFRPHMIED IQRAGSGSRRDQARQLIIDLETRGSQALPLFISCLEDTGQDM LASFLRTNRQAAKLSKPTLENLTPVVLRPEIRKPEVLRPETP RPVDIGSGGFGDVGALESLRGNADLAYILSMEPCGHCLIINN VNFCRESGLRTRTGSNIDCEKLRRRFSSLHFMVEVKGDLTAK KMVLALLELAQQDHGALDCCVVVILSHGCQASHLQFPGAVYG TDGCPVSVEKIVNIFNGTSCPSLGGKPKLFFIQACGGEQKDH | 2969 | 5647 |

TABLE 39-continued

DD-Caspase 9 constructs

| Description/<br>Construct ID | Amino acid sequence | Amino Acid<br>SEQ ID NO. | Nucleic Acid<br>SEQ ID NO. |
|---|---|---|---|
| Caspase 9<br>(amino acid 2-<br>416 of SEQ ID<br>NO. 412) | GFEVASTSPEDESPGSNPEPDATPFQEGLRTFDQLDAISSLP<br>TPSDIFVSYSTFPGFVSWRDPKSGSWYVETLDDIFEQWAHSE<br>DLQSLLLRVANAVSVKGIYKQMPGCFNFLRKKLFFKTS*<br>DEADRRLLRRCRLRLVEELQVDQLWDALLSRELFRPHMIEDI<br>QRAGSGSRRDQARQLIIDLETRGSQALPLFISCLEDTGQDML<br>ASFLRTNRQAAKLSKPTLENLTPVVLRPEIRKPEVLRPETPR<br>PVDIGSGGFGDVGALESLRGNADLAYILSMEPCGHCLIINNV<br>NFCRESGLRTRTGSNIDCEKLRRRFSSLHFMVEVKGDLTAKK<br>MVLALLELAQQDHGALDCCVVVILSHGCQASHLQFPGAVYGT<br>DGCPVSVEKIVNIFNGTSCPSLGGKPKLFFIQACGGEQKDHG<br>FEVASTSPEDESPGSNPEPDATPFQEGLRTFDQLDAISSLPT<br>PSDIFVSYSTFPGFVSWRDPKSGSWYVETLDDIFEQWAHSED<br>LQSLLLRVANAVSVKGIYKQMPGCFNFLRKKLFFKTS* | 2970 | 5648 |
| Linker | SGGGS | 2971 | 5649 |
| hDHFR<br>(Y122I) | MVGSLNCIVAVSQNMGIGKNGDLPWPPLRNEFRYFQRMTTTS<br>SVEGKQNLVIMGKKTWFSIPEKNRPLKGRINLVLSRELKEPP<br>QGAHFLSRSLDDALKLTEQPELANKVDMVWIVGGSSVIKEAM<br>NHPGHLKLFVTRIMQDFESDTFFPEIDLEKYKLLPEYPGVLS<br>DVQEEKGIKYKFEVYEKND | 11 | 5650 |
| hDHFR<br>(V75F, Y122I) | MVGSLNCIVAVSQNMGIGKNGDLPWPPLRNEFRYFQRMTTTS<br>SVEGKQNLVIMGKKTWFSIPEKNRPLKGRINLFLSRELKEPP<br>QGAHFLSRSLDDALKLTEQPELANKVDMVWIVGGSSVIKEAM<br>NHPGHLKLFVTRIMQDFESDTFFPEIDLEKYKLLPEYPGVLS<br>DVQEEKGIKYKFEVYEKND | 27 | 5651 |
| hDHFR<br>(L94A, T147A) | MVGSLNCIVAVSQNMGIGKNGDLPWPPLRNEFRYFQRMTTTS<br>SVEGKQNLVIMGKKTWFSIPEKNRPLKGRINLVLSRELKEPP<br>QGAHFLSRSADDALKLTEQPELANKVDMVWIVGGSSVYKEAM<br>NHPGHLKLFVTRIMQDFESDAFFPEIDLEKYKLLPEYPGVLS<br>DVQEEKGIKYKFEVYEKND | 20 | 5652 |
| OT-CASP9-003<br>(hDHFR(Y122<br>I); linker<br>(SGGGS (SEQ<br>ID NO: 3089));<br>Caspase 9;<br>stop) | MVGSLNCIVAVSQNMGIGKNGDLPWPPLRNEFRYFQRMTTTS<br>SVEGKQNLVIMGKKTWFSIPEKNRPLKGRINLVLSRELKEPP<br>QGAHFLSRSLDDALKLTEQPELANKVDMVWIVGGSSVIKEAM<br>NHPGHLKLFVTRIMQDFESDTFFPEIDLEKYKLLPEYPGVLS<br>DVQEEKGIKYKFEVYEKNDSGGGSDEADRRLLRRCRLRLVEE<br>LQVDQLWDALLSRELFRPHMIEDIQRAGSGSRRDQARQLIID<br>LETRGSQALPLFISCLEDTGQDMLASFLRTNRQAAKLSKPTL<br>ENLTPVVLRPEIRKPEVLRPETPRPVDIGSGGFGDVGALESL<br>RGNADLAYILSMEPCGHCLIINNVNFCRESGLRTRTGSNIDC<br>EKLRRRFSSLHFMVEVKGDLTAKKMVLALLELAQQDHGALDC<br>CVVVILSHGCQASHLQFPGAVYGTDGCPVSVEKIVNIFNGTS<br>CPSLGGKPKLFFIQACGGEQKDHGFEVASTSPEDESPGSNPE<br>PDATPFQEGLRTFDQLDAISSLPTPSDIFVSYSTFPGFVSWR<br>DPKSGSWYVETLDDIFEQWAHSEDLQSLLLRVANAVSVKGIY<br>KQMPGCFNFLRKKLFFKTS* | 2972 | 5653 |
| OT-CASP9-<br>004 (hDHFR<br>(V75F,<br>Y122I); linker<br>(SGGGS (SEQ<br>ID NO: 3089));<br>Caspase 9;<br>stop) | MVGSLNCIVAVSQNMGIGKNGDLPWPPLRNEFRYFQRMTTTS<br>SVEGKQNLVIMGKKTWFSIPEKNRPLKGRINLFLSRELKEPP<br>QGAHFLSRSLDDALKLTEQPELANKVDMVWIVGGSSVIKEAM<br>NHPGHLKLFVTRIMQDFESDTFFPEIDLEKYKLLPEYPGVLS<br>DVQEEKGIKYKFEVYEKNDSGGGSDEADRRLLRRCRLRLVEE<br>LQVDQLWDALLSRELFRPHMIEDIQRAGSGSRRDQARQLIID<br>LETRGSQALPLFISCLEDTGQDMLASFLRTNRQAAKLSKPTL<br>ENLTPVVLRPEIRKPEVLRPETPRPVDIGSGGFGDVGALESL<br>RGNADLAYILSMEPCGHCLIINNVNFCRESGLRTRTGSNIDC<br>EKLRRRFSSLHFMVEVKGDLTAKKMVLALLELAQQDHGALDC<br>CVVVILSHGCQASHLQFPGAVYGTDGCPVSVEKIVNIFNGTS<br>CPSLGGKPKLFFIQACGGEQKDHGFEVASTSPEDESPGSNPE<br>PDATPFQEGLRTFDQLDAISSLPTPSDIFVSYSTFPGFVSWR<br>DPKSGSWYVETLDDIFEQWAHSEDLQSLLLRVANAVSVKGIY<br>KQMPGCFNFLRKKLFFKTS* | 2973 | 5654 |
| OT-CASP9-<br>005 (hDHFR<br>(L94A,<br>T147A); linker<br>(SGGGS (SEQ<br>ID NO: 3089));<br>Caspase 9;<br>stop) | MVGSLNCIVAVSQNMGIGKNGDLPWPPLRNEFRYFQRMTTTS<br>SVEGKQNLVIMGKKTWFSIPEKNRPLKGRINLVLSRELKEPP<br>QGAHFLSRSADDALKLTEQPELANKVDMVWIVGGSSVYKEAM<br>NHPGHLKLFVTRIMQDFESDAFFPEIDLEKYKLLPEYPGVLS<br>DVQEEKGIKYKFEVYEKNDSGGGSDEADRRLLRRCRLRLVEE<br>LQVDQLWDALLSRELFRPHMIEDIQRAGSGSRRDQARQLIID<br>LETRGSQALPLFISCLEDTGQDMLASFLRTNRQAAKLSKPTL<br>ENLTPVVLRPEIRKPEVLRPETPRPVDIGSGGFGDVGALESL<br>RGNADLAYILSMEPCGHCLIINNVNFCRESGLRTRTGSNIDC | 2974 | 5655 |

TABLE 39-continued

| DD-Caspase 9 constructs | | | |
|---|---|---|---|
| Description/ Construct ID | Amino acid sequence | Amino Acid SEQ ID NO. | Nucleic Acid SEQ ID NO. |
| | EKLRRRFSSLHFMVEVKGDLTAKKMVLALLELAQQDHGALDC CVVVILSHGCQASHLQFPGAVYGTDGCPVSVEKIVNIFNGTS CPSLGGKPKLFFIQACGGEQKDHGFEVASTSPEDESPGSNPE PDATPFQEGLRTFDQLDAISSLPTPSDIFVSYSTFPGFVSWR DPKSGSWYVETLDDIFEQWAHSEDLQSLLLRVANAVSVKGIY KQMPGCFNFLRKKLFFKTS* | | |

TABLE 40

| DD-Caspase 9 constructs | | | |
|---|---|---|---|
| Description Construct ID | Amino acid sequence | Amino Acid SEQ ID NO. | Nucleic Acid SEQ ID NO./ Sequence |
| Caspase 9 | DEADRRLLRRCRLRLVEELQVDQLWDALLSRELFRPHMIEDIQR AGSGSRRDQARQLIIDLETRGSQALPLFISCLEDTGQDMLASFL RTNRQAAKLSKPTLENLTPVVLRPEIRKPEVLRPETPRPVDIGS GGFGDVGALESLRGNADLAYILSMEPCGHCLIINNVNFCRESGL RTRTGSNIDCEKLRRRFSSLHFMVEVKGDLTAKKMVLALLELAQ QDHGALDCCVVVILSHGCQASHLQFPGAVYGTDGCPVSVEKIVN IFNGTSCPSLGGKPKLFFIQACGGEQKDHGFEVASTSPEDESPG SNPEPDATPFQEGLRTFDQLDAISSLPTPSDIFVSYSTFPGFVS WRDPKSGSWYVETLDDIFEQWAHSEDLQSLLLRVANAVSVKGIY KQMPGCFNFLRKKLFFKTS | 2742 | 5660, 5661 |
| Caspase delta CD | GVDGFGDVGALESLRGNADLAYILSMEPCGHCLIINNVNFCRES GLRTRTGSNIDCEKLRRRFSSLHFMVEVKGDLTAKKMVLALLEL ARQDHGALDCCVVVILSHGCQASHLQFPGAVYGTDGCPVSVEKI VNIFNGTSCPSLGGKPKLFFIQACGGEQKDHGFEVASTSPEDES PGSNPEPDATPFQEGLRTFDQLDAISSLPTPSDIFVSYSTFPGF VSWRDPKSGSWYVETLDDIFEQWAHSEDLQSLLLRVANAVSVKG IYKQMPGCFNFLRKKLFFKTS | 2975 | 5662 |
| Linker | VDYPYDVPDYALD | 2976 | 5663 |
| Linker | SGGGS | 2977 | 5664, 5665, 5666 |
| Linker | QLIGMLQGLMRDL | 3082 | 5667 |
| Linker | SG | — | — |
| FKBP (F36V, L106P) | GVQVETISPGDGRTFPKRGQTCVVHYTGMLEDGKKVDSSRDRNK PFKFMLGKQEVIRGWEEGVAQMSVGQRAKLTISPDYAYGATGHP GIIPPHATLVFDVELLKPE | 2778 | 5668, 5669-5673 |
| FKBP (F36V) | GVQVETISPGDGRTFPKRGQTCVVHYTGMLEDGKKVDSSRDRNK PFKFMLGKQEVIRGWEEGVAQMSVGQRAKLTISPDYAYGATGHP GIIPPHATLVFDVELLKLE | 2978 | 5674 |
| FKBP (E31G, F36V, R71G, K105E) | GVQVETISPGDGRTFPKRGQTCVVHYTGMLGDGKKVDSSRDRNK PFKFMLGKQEVIRGWEEGVAQMSVGQGAKLTISPDYAYGATGHP GIIPPHATLVFDVELLELE | 2775 | 5675, 5676-5682 |
| ecDHFR (R12Y, Y100I) | MISLIAALAVDYVIGMENANPWNLPADLAWFKRNTLNKPVIMGR HTWESIGRPLPGRKNIILSSQPGTDDRVTWVKSVDEAIAACGDV PEIMVIGGGRVIEQFLPKAQKLYLTHIDAEVEGDTHFPDYEPDD WESVFSEFHDADAQNSHSYCFEILERR | 2979 | 5683 |
| ecDHFR (Amino acid 2-159 of WT) (R12Y, E129K) | ISLIAALAVDYVIGMENAMPWNLPADLAWFKRNTLNKPVIMGRH TWESIGRPLPGRKNIILSSQPGTDDRVTWVKSVDEAIAACGDVP EIMVIGGGRVYEQFLPKAQKLYLTHIDAEVEGDTHFPDYKPDDW ESVFSEFHDADAQNSHSYCFEILERR | 2980 | 5684 |
| ecDHFR (Amino acid 2-159 of WT) R12Y, Y100I) | ISLIAALAVDYVIGMENAMPWNLPADLAWFKRNTLNKPVIMGRH TWESIGRPLPGRKNIILSSQPGTDDRVTWVKSVDEAIAACGDVP EIMVIGGGRVIEQFLPKAQKLYLTHIDAEVEGDTHFPDYEPDDW ESVFSEFHDADAQNSHSYCFEILERR | 2774 | 5685, 5686-5691 |

TABLE 40-continued

DD-Caspase 9 constructs

| Description Construct ID | Amino acid sequence | Amino Acid SEQ ID NO. | Nucleic Acid SEQ ID NO./ Sequence |
|---|---|---|---|
| hDHFR (Y122I) | MVGSLNCIVAVSQNMGIGKNGDLPWPPLRNEFRYFQRMTTTSSV EGKQNLVIMGKKTWFSIPEKNRPLKGRINLVLSRELKEPPQGAH FLSRSLDDALKLTEQPELANKVDMVWIVGGSSVIKEAMNHPGHL KLFVTRIMQDFESDTFFPEIDLEKYKLLPEYPGVLSDVQEEKGI KYKFEVYEKND | 2981 | 5692 |
| hDHFR (V75F, Y122I) | MVGSLNCIVAVSQNMGIGKNGDLPWPPLRNEFRYFQRMTTTSSV EGKQNLVIMGKKTWFSIPEKNRPLKGRINLFLSRELKEPPQGAH FLSRSLDDALKLTEQPELANKVDMVWIVGGSSVIKEAMNHPGHL KLFVTRIMQDFESDTFFPEIDLEKYKLLPEYPGVLSDVQEEKGI KYKFEVYEKND | 2982 | 5693 |
| hDHFR (L94A, T147A) | MVGSLNCIVAVSQNMGIGKNGDLPWPPLRNEFRYFQRMTTTSSV EGKQNLVIMGKKTWFSIPEKNRPLKGRINLVLSRELKEPPQGAH FLSRSADDALKLTEQPELANKVDMVWIVGGSSVYKEAMNHPGHL KLFVTRIMQDFESDAFFPEIDLEKYKLLPEYPGVLSDVQEEKGI KYKFEVYEKND | 2983 | 5694 |
| OT-CASP9-001 (Met-FKBP (F36V, L106P)-Linker (SGGGS (SEQ ID NO: 3089))-Caspase 9-stop) | MGVQVETISPGDGRTFPKRGQTCVVHYTGMLEDGKKVDSSRDRN KPPKFMLGKQEVIRGWEEGVAQMSVGQRAKLTISPDYAYGATGH PGIIPPHATLVFDVELLKPESGGGSDEADRRLLRRCRLRLVEEL QVDQLWDALLSRELFRPHMIEDIQRAGSGSRRDQARQLIIDLET RGSQALPLFISCLEDTGQDMLASFLRTNRQAAKLSKPTLENLTP VVLRPEIRKPEVLRPETPRPVDIGSGGFGDVGALESLRGNADLA YILSMEPCGHCLIINNVNFCRESGLRTRTGSNIDCEKLRRRFSS LHFMVEVKGDLTAKKMVLALLELAQQDHGALDCCVVVILSHGCQ ASHLQFPGAVYGTDGCPVSVEKIVNIFNGTSCPSLGGKPKLFFI QACGGEQKDHGFEVASTSPEDESPGSNPEPDATPFQEGLRTFDQ LDAISSLPTPSDIFVSYSTFPGFVSWRDPKSGSWYVETLDDIFE QWAHSEDLQSLLLRVANAVSVKGIYKQMPGCFNFLRKKLFFKTS* | 1149 | 5695 |
| OT-CASP9-002 (ecDHFR (R12Y, Y100I)-Linker (SGGGS (SEQ ID NO: 3089))-Caspase 9-stop) | MISLIAALAVDYVIGMENAMPWNLPADLAWFKRNTLNKPVIMGR HTWESIGRPLPGRKNIILSSQPGTDDRVTWVKSVDEAIAACGDV PEIMVIGGGRVIEQFLPKAQKLYLTHIDAEVEGDTHFPDYEPDD WESVFSEFHDADAQNSHSYCFEILERRSGGGSDEADRRLLRRCR LRLVEELQVDQLWDALLSRELFRPHMIEDIQRAGSGSRRDQARQ LIIDLETRGSQALPLFISCLEDTGQDMLASFLRTNRQAAKLSKP TLENLTPVVLRPEIRKPEVLRPETPRPVDIGSGGFGDVGALESL RGNADLAYILSMEPCGHCLIINNVNFCRESGLRTRTGSNIDCEK LRRRFSSLHFMVEVKGDLTAKKMVLALLELAQQDHGALDCCVVV ILSHGCQASHLQFPGAVYGTDGCPVSVEKIVNIFNGTSCPSLGG KPKLFFIQACGGEQKDHGFEVASTSPEDESPGSNPEPDATPFQE GLRTFDQLDAISSLPTPSDIFVSYSTFPGFVSWRDPKSGSWYVE TLDDIFEQWAHSEDLQSLLLRVANAVSVKGIYKQMPGCFNFLRK KLFFKTS* | 1150 | 5696 |
| OT-CASP9-003 (hDHFR (Y122I)-Linker (SGGGS (SEQ ID NO: 3089))-Caspase 9-stop) | MVGSLNCIVAVSQNMGIGKNGDLPWPPLRNEFRYFQRMTTTSSV EGKQNLVIMGKKTWFSIPEKNRPLKGRINLVLSRELKEPPQGAH FLSRSLDDALKLTEQPELANKVDMVWIVGGSSVIKEAMNHPGHL KLFVTRIMQDFESDTFFPEIDLEKYKLLPEYPGVLSDVQEEKGI KYKFEVYEKNDSGGGSDEADRRLLRRCRLRLVEELQVDQLWDAL LSRELFRPHMIEDIQRAGSGSRRDQARQLIIDLETRGSQALPLF ISCLEDTGQDMLASFLRTNRQAAKLSKPTLENLTPVVLRPEIRK PEVLRPETPRPVDIGSGGFGDVGALESLRGNADLAYILSMEPCG HCLIINNVNFCRESGLRTRTGSNIDCEKLRRRFSSLHFMVEVKG DLTAKKMVLALLELAQQDHGALDCCVVVILSHGCQASHLQFPGA VYGTDGCPVSVEKIVNIFNGTSCPSLGGKPKLFFIQACGGEQKD HGFEVASTSPEDESPGSNPEPDATPFQEGLRTFDQLDAISSLPT PSDIFVSYSTFPGFVSWRDPKSGSWYVETLDDIFEQWAHSEDLQ SLLLRVANAVSVKGIYKQMPGCFNFLRKKLFFKTS* | 1151 | 5697 |
| OT-CASP9-004 (hDHFR (V75F, Y122I)-Linker (SGGGS (SEQ ID NO: 3089))-Caspase 9-stop) | MVGSLNCIVAVSQNMGIGKNGDLPWPPLRNEFRYFQRMTTTSSV EGKQNLVIMGKKTWFSIPEKNRPLKGRINLFLSRELKEPPQGAH FLSRSLDDALKLTEQPELANKVDMVWIVGGSSVIKEAMNHPGHL KLFVTRIMQDFESDTFFPEIDLEKYKLLPEYPGVLSDVQEEKGI KYKFEVYEKNDSGGGSDEADRRLLRRCRLRLVEELQVDQLWDAL LSRELFRPHMIEDIQRAGSGSRRDQARQLIIDLETRGSQALPLF ISCLEDTGQDMLASFLRTNRQAAKLSKPTLENLTPVVLRPEIRK PEVLRPETPRPVDIGSGGFGDVGALESLRGNADLAYILSMEPCG HCLIINNVNFCRESGLRTRTGSNIDCEKLRRRFSSLHFMVEVKG DLTAKKMVLALLELAQQDHGALDCCVVVILSHGCQASHLQFPGA VYGTDGCPVSVEKIVNIFNGTSCPSLGGKPKLFFIQACGGEQKD | 1152 | 5698 |

TABLE 40-continued

DD-Caspase 9 constructs

| Description Construct ID | Amino acid sequence | Amino Acid SEQ ID NO. | Nucleic Acid SEQ ID NO./ Sequence |
|---|---|---|---|
| | HGFEVASTSPEDESPGSNPEPDATPFQEGLRTFDQLDAISSLPT<br>PSDIFVSYSTFPGFVSWRDPKSGSWYVETLDDIFEQWAHSEDLQ<br>SLLLRVANAVSVKGIYKQMPGCFNFLRKKLFFKTS* | | |
| OT-CASP9-<br>005 (hDHFR<br>(L94A,<br>T147A)-<br>Linker<br>(SGGGS (SEQ<br>ID NO: 3089))<br>-Caspase 9-<br>stop) | MVGSLNCIVAVSQNMGIGKNGDLPWPPLRNEFRYFQRMTTTSSV<br>EGKQNLVIMGKKTWFSIPEKNRPLKGRINLVLSRELKEPPQGAH<br>FLSRSADDALKLTEQPELANKVDMVWIVGGSSVYKEAMNHPGHL<br>KLFVTRIMQDFESDAFFPEIDLEKYKLLPEYPGVLSDVQEEKGI<br>KYKFEVYEKNDSGGGSDEADRRLLRRCRLRLVEELQVDQLWDAL<br>LSRELFRPHMIEDIQRAGSGSRRDQARQLIIDLETRGSQALPLF<br>ISCLEDTGQDMLASFLRTNRQAAKLSKPTLENLTPVVLRPEIRK<br>PEVLRPETPRPVDIGSGGFGDVGALESLRGNADLAYILSMEPCG<br>HCLIINNVNFCRESGLRTRTGSNIDCEKLRRRFSSLHFMVEVKG<br>DLTAKKMVLALLELAQQDHGALDCCVVVILSHGCQASHLQFPGA<br>VYGTDGCPVSVEKIVNIFNGTSCPSLGGKPKLFFIQACGGEQKD<br>HGFEVASTSPEDESPGSNPEPDATPFQEGLRTFDQLDAISSLPT<br>PSDIFVSYSTFPGFVSWRDPKSGSWYVETLDDIFEQWAHSEDLQ<br>SLLLRVANAVSVKGIYKQMPGCFNFLRKKLFFKTS* | 1153 | 5699 |
| OT-CASP9-<br>006 (Met-<br>Leu-Glu-<br>FKBP (F36V)<br>-Linker<br>(SGGGS (SEQ<br>ID NO: 3089))<br>-Caspase<br>Delta CD-<br>Linker<br>(QLIGMLQG<br>LMRDL (SEQ<br>ID NO: 3090))<br>-stop) | MLEGVQVETISPGDGRTFPKRGQTCVVHYTGMLEDGKKVDSSRD<br>RNKPFKFMLGKQEVIRGWEEGVAQMSVGQRAKLTISPDYAYGAT<br>GHPGIIPPHATLVFDVELLKLESGGGSGVDGFGDVGALESLRGN<br>ADLAYILSMEPCGHCLIINNVNFCRESGLRTRTGSNIDCEKLRR<br>RFSSLHFMVEVKGDLTAKKMVLALLELARQDHGALDCCVVVILS<br>HGCQASHLQFPGAVYGTDGCPVSVEKIVNIFNGTSCPSLGGKPK<br>LFFIQACGGEQKDHGFEVASTSPEDESPGSNPEPDATPFQEGLR<br>TFDQLDAISSLPTPSDIFVSYSTFPGFVSWRDPKSGSWYVETLD<br>DIFEQWAHSEDLQSLLLRVANAVSVKGIYKQMPGCFNFLRKKLF<br>FKTSQLIGMLQGLMRDL* | 1154 | 5700 |
| OT-CASP9-<br>007 (Met-<br>Caspase 9-<br>Linker (SG)-<br>FKBP (E31G,<br>F36V, R71G,<br>K105E)-stop) | MDEADRRLLRRCRLRLVEELQVDQLWDALLSRELFRPHMIEDIQ<br>RAGSGSRRDQARQLIIDLETRGSQALPLFISCLEDTGQDMLASF<br>LRTNRQAAKLSKPTLENLTPVVLRPEIRKPEVLRPETPRPVDIG<br>SGGFGDVGALESLRGNADLAYILSMEPCGHCLIINNVNFCRESG<br>LRTRTGSNIDCEKLRRRFSSLHFMVEVKGDLTAKKMVLALLELA<br>QQDHGALDCCVVVILSHGCQASHLQFPGAVYGTDGCPVSVEKIV<br>NIFNGTSCPSLGGKPKLFFIQACGGEQKDHGFEVASTSPEDESP<br>GSNPEPDATPFQEGLRTFDQLDAISSLPTPSDIFVSYSTFPGFV<br>SWRDPKSGSWYVETLDDIFEQWAHSEDLQSLLLRVANAVSVKGI<br>YKQMPGCFNFLRKKLFFKTSSGGVQVETISPGDGRTFPKRGQTC<br>VVHYTGMLGDGKKVDSSRDRNKPFKFMLGKQEVIRGWEEGVAQM<br>SVGQGAKLTISPDYAYGATGHPGIIPPHATLVFDVELLELE* | 1155 | 5701 |
| OT-CASP9-<br>008 (Met-<br>Caspase 9-<br>Linker (SG)-<br>ecDHFR<br>(Amino acid 2-<br>159 of WT)<br>(R12Y, Y100I)-<br>stop | MDEADRRLLRRCRLRLVEELQVDQLWDALLSRELFRPHMIEDIQ<br>RAGSGSRRDQARQLIIDLETRGSQALPLFISCLEDTGQDMLASF<br>LRTNRQAAKLSKPTLENLTPVVLRPEIRKPEVLRPETPRPVDIG<br>SGGFGDVGALESLRGNADLAYILSMEPCGHCLIINNVNFCRESG<br>LRTRTGSNIDCEKLRRRFSSLHFMVEVKGDLTAKKMVLALLELA<br>QQDHGALDCCVVVILSHGCQASHLQFPGAVYGTDGCPVSVEKIV<br>NIFNGTSCPSLGGKPKLFFIQACGGEQKDHGFEVASTSPEDESP<br>GSNPEPDATPFQEGLRTFDQLDAISSLPTPSDIFVSYSTFPGFV<br>SWRDPKSGSWYVETLDDIFEQWAHSEDLQSLLLRVANAVSVKGI<br>YKQMPGCFNFLRKKLFFKTSSGISLIAALAVDYVIGMENAMPWN<br>LPADLAWFKRNTLNKPVIMGRHTWESIGRPLPGRKNIILSSQPG<br>TDDRVTWVKSVDEAIAACGDVPEIMVIGGGRVIEQFLPKAQKLY<br>LTHIDAEVEGDTHFPDYEPDDWESVFSEFHDADAQNSHSYCFEI<br>LERR* | 1156 | 5702 |
| OT-CASP9-<br>009 (Met-<br>Caspase 9-<br>Linker (SG)-<br>ecDHFR<br>(Amino acid 2-<br>159 of WT)<br>(R12Y, E129K)-<br>stop) | MDEADRRLLRRCRLRLVEELQVDQLWDALLSRELFRPHMIEDIQ<br>RAGSGSRRDQARQLIIDLETRGSQALPLFISCLEDTGQDMLASF<br>LRTNRQAAKLSKPTLENLTPVVLRPEIRKPEVLRPETPRPVDIG<br>SGGFGDVGALESLRGNADLAYILSMEPCGHCLIINNVNFCRESG<br>LRTRTGSNIDCEKLRRRFSSLHFMVEVKGDLTAKKMVLALLELA<br>QQDHGALDCCVVVILSHGCQASHLQFPGAVYGTDGCPVSVEKIV<br>NIFNGTSCPSLGGKPKLFFIQACGGEQKDHGFEVASTSPEDESP<br>GSNPEPDATPFQEGLRTFDQLDAISSLPTPSDIFVSYSTFPGFV<br>SWRDPKSGSWYVETLDDIFEQWAHSEDLQSLLLRVANAVSVKGI<br>YKQMPGCFNFLRKKLFFKTSSGISLIAALAVDYVIGMENAMPWN<br>LPADLAWFKRNTLNKPVIMGRHTWESIGRPLPGRKNIILSSQPG | 1157 | 5703 |

TABLE 40-continued

DD-Caspase 9 constructs

| Description Construct ID | Amino acid sequence | Amino Acid SEQ ID NO. | Nucleic Acid SEQ ID NO./ Sequence |
|---|---|---|---|
| | TDDRVTWVKSVDEAIAACGDVPEIMVIGGGRVYEQFLPKAQKLY LTHIDAEVEGDTHFPDYKPDDWESVFSEFHDADAQNSHSYCFEI LERR* | | |

In some instances, the iCasp9/CID system has been shown to have a basal rate of dimerization even in the absence of rimiducid, resulting in unintended cell death. Regulating the expression levels of iCasp9/CID is critical for maximizing the efficacy of iCasp9/CID system. Biocircuits of the present invention and/or any of their components may be utilized in regulating or tuning the iCasp9/CID system to optimize its utility. Other examples of proteins used in dimerization-induced apoptosis paradigm may include, but are not limited to Fas receptor, the death effector domain of Fas-associated protein, FADD, Caspase 1, Caspase 3, Caspase 7 and Caspase 8. (Belshaw P. J. et al, Chem Biol., 996, 3:731-738; MacCorkle R. A. et al, Proc Natl Acad Sci, 1998, 95:3655-3660; Spencer, D. M. et al., Curr Biol. 1996; 6:839-847; the contents of each of which are incorporated herein by reference in their entirety).

In some embodiments, the safety switch of the present invention may comprise a metabolic enzyme, such as herpes simplex virus thymidine kinase (HSV-TK) and cytosine deaminase (CD). HSV-TK phosphorylates nucleoside analogs, including acyclovir and ganciclovir (GCV) to generate triphosphate form of nucleosides. When incorporated into DNA, it leads to chain termination and cell death. Unlike the mammalian thymidine kinase, HSV-TK is characterized by 1000-fold higher affinity to nucleoside analogs such as GCV, making it suitable for use as a suicide gene in mammalian cells. Cytosine deaminase (CD) can converts 5-fluorocytosine (5-FC) into the cytotoxic 5-fluorouracil (5-FU) (Tiraby et al., FEMS Lett., 1998, 167: 41-49).

In some embodiments, the safety switch of the present invention may comprise a CYP4B1 mutant (as suicide gene), which may be co-expressed in a CAR engineered T cells (Roellecker et al., Gen Ther., 2016, May 19, doi: 10.1038/gt.2016.38.).

In some embodiments, the payload of the present invention may comprise a fusion construct that can induce cell death, for example, a polypeptide with the formula of St-R1-S 1-Q-S2-R2, wherein the St is a stalk sequence, R1/2 and Q are different epitopes; and S1/2 are optional spacer sequences (See International Patent Publication NO. WO2013153391; the content of which are incorporated herein by reference in their entirety).

In some embodiments, safety switch may be mediated by therapeutic antibodies which specifically bind to an antigen that is expressed in the plasma membrane of adoptively transferred cells. The antigen-antibody interaction allows cell removal after administration of a specific monoclonal antibody against the antigen. As non-limiting examples, payloads of the present invention may comprise the antigen and antibody pair used to mediate safety switch such as CD20 and anti-CD20 antibody (Griffioen et al., Haematologica, 2009, 94:1316-1320), a protein tag and anti-tag antibody (Kieback et al., Natl. Acad. Sci. U.S.A., 2008, 105: 623-628), a compact suicide gene (RQR8) combining epitopes from CD34 (as a marker moiety) and CD20 (as a suicide moiety) which enables CD34 selection, cell tracking, as well as cell deletion after anti-CD20 monoclonal antibody administration (Philip et al., Blood, 2014, 124: 1277-1287); truncated human EGFR polypeptide and anti-EGFR monoclonal antibody (Wang et al., Blood, 2011, 118:1255-1263); and a compact polypeptide safety switch having a structural formula as discussed in U.S Patent Application Publication NO. US20150093401; the contents of each of which are incorporated herein by reference in their entirety.

Regulatory Switch

The utility of adoptive cell therapy (ACT) has been limited by the high incidence of graft versus host disease (GVHD). GVHD occurs when adoptively transferred T cells elicit an immune response resulting in host tissue damage. Recognition of host antigens by the graft cells triggers a proinflammatory cytokine storm cascade that signifies acute GVHD. GVHD is characterized as an imbalance between the effector and the regulatory arms of the immune system. In some embodiments, the payloads of the present invention may be used as regulatory switches. As used herein "regulatory switch" refers proteins, which when expressed in target cells increase tolerance to the graft by enhancing the regulatory arm of the immune system.

In one embodiment, regulatory switches may include payloads that preferentially promote the expansion of regulatory T (Treg cells). Tregs are a distinct population of cells that are positively selected on high affinity ligands in the thymus and play an important role in the tolerance to self-antigens. In addition, T regs have also been shown to play a role in peripheral tolerance to foreign antigens. Since Tregs promote immune tolerance, expansion of Tregs with the compositions of the invention may be desirable to limit GVHD.

In some embodiments, the regulatory switch may include, but is not limited to T regs activation factors such NFκB, FOXO, nuclear receptor Nr4a, Retinoic acid receptor alpha, NFAT, AP-1 and SMAD. Such factors can result in the expression of Fork headbox P3 (FOXP3) in T cells resulting in the activation of the regulatory T cell program and the expansion of T cells.

In one embodiment, the regulatory switch may be FOXP3, a transcriptional regulator in T cells. A function of FOXP3 is to suppress the function of NFAT, which leads to the suppression of expression of many genes including IL2 and effector T-cell cytokines. FOXP3 acts also as a transcription activator for genes such as CD2S, Cytotoxic T-Lymphocyte Antigen Cytotoxic T-Lymphocyte Antigen 4 (CTLA4), glucocorticoid-induced TNF receptor family gene (GITR) and folate receptor 4. FOXP3 also inhibits the differentiation of IL17 producing helper T-cells (Th17) by antagonizing RORC (RAR related orphan receptor C). Isoforms of FOXP3 lacking exon2 (FOXP3 delta 2), or exon 7 (FOXP3 delta 7) may also be used as regulatory switches. In one aspect, the effector module of the invention may be a DD-FOXP3 fusion polypeptide. The DD-FOXP3 may comprise the amino acid sequences provided in Table 41. The amino acid sequences in Table 41 may comprise a stop codon which is denoted in the table with a "*" at the end of the amino acid sequence.

TABLE 41

DD-FOXP3 constructs

| Construct Description | Amino Acid sequence | Amino Acid SEQ ID NO. | Nucleic Acid SEQ ID NO. |
|---|---|---|---|
| Linker | SGGGS | 2977 | 5704, 5705, 5706 |
| Linker | SG | — | |
| FKBP (F36V, L106P) | GVQVETISPGDGRTFPKRGQTCVVHYTGMLEDGKKVD SSRDRNKPFKFMLGKQEVIRGWEEGVAQMSVGQRAKL TISPDYAYGATGHPGIIPPHATLVFDVELLKPE | 2778 5708-5712 | 5707, |
| FKBP (E31G, F36V, R71G, K105E) | GVQVETISPGDGRTFPKRGQTCVVHYTGMLDGKKVD SSRDRNKPFKFMLGKQEVIRGWEEGVAQMSVGQGAKL TISPDYAYGATGHPGIIPPHATLVFDVELLELEMISL | 2775 | 5713, 5714-5720 |
| ecDHFR (R12Y, Y100I) | IAALAVDYVIGMENANPWNLPADLAWFKRNTLNKPVI MGRHTWESIGRPLPGRKNIILSSQPGTDDRVTWVKSV DEAIAACGDVPEIMVIGGGRVIEQFLPKAQKLYLTHI DAEVEGDTHFPDYEPDDWESVFSEFHDADAQNSHSYC FEILERR | 2979 | 5721 |
| ecDHFR (Amino acid 2-159 of WT) (R12Y, Y100I) | ISLIAALAVDYVIGMENANPWNLPADLAWFKRNTLNK PVIMGRHTWESIGRPLPGRKNIILSSQPGTDDRVTWV KSVDEAIAACGDVPEIMVIGGGRVIEQFLPKAQKLYL THIDAEVEGDTHFPDYEPDDWESVFSEFHDADAQNSH SYCFEILERR | 2774 | 5722, 5723, 5724 |
| FOXP3 full length | MPNPRPGKPSAPSLALGPSPGASPSWRAAPKASDLLG ARGPGGTFQGRDLRGGAHASSSSLNPMPPSQLQLPTL PLVMVAPSGARLGPLPHLQALLQDRPHFMHQLSTVDA HARTPVLQVHPLESPAMISLTPPTTATGVFSLKARPG LPPGINVASLEWVSREPALLCTFPNPSAPRKDSTLSA VPQSSYPLLANGVCKWPGCEKVFEEPEDFLKHCQADH LLDEKGRAQCLLQREMVQSLEQQLVLEKEKLSAMQAH LAGKMALTKASSVASSDKGSCCIVAAGSQGPVVPAWS GPREAPDSLFAVRRHLWGSHGNSTFPEFLHNMDYFKF HNMRPPFTYATLIRWAILEAPEKQRTLNEIYHWFTRM FAFFRNHPATWKNAIRHNLSLHKCFVRVESEKGAVWT VDELEFRKKRSQRPSRCSNPTPGP* | 2771 | 5725 |
| Amino Acid 2-431 of FOXP3 full length | PNPRPGKPSAPSLALGPSPGASPSWRAAPKASDLLGA RGPGGTFQGRDLRGGAHASSSSLNPMPPSQLQLPTLP LVMVAPSGARLGPLPHLQALLQDRPHFMHQLSTVDAH ARTPVLQVHPLESPAMISLTPPTTATGVFSLKARPGL PPGINVASLEWVSREPALLCTFPNPSAPRKDSTLSAV PQSSYPLLANGVCKWPGCEKVFEEPEDFLKHCQADHL LDEKGRAQCLLQREMVQSLEQQLVLEKEKLSAMQAHL AGKMALTKASSVASSDKGSCCIVAAGSQGPVVPAWSG PREAPDSLFAVRRHLWGSHGNSTFPEFLHNMDYFKFH NMRPPFTYATLIRWAILEAPEKQRTLNEIYHWFTRMF AFFRNHPATWKNAIRHNLSLHKCFVRVESEKGAVWTV DELEFRKKRSQRPSRCSNPTPGP | 746 | 5726 |
| FOXP3 delta 2 | MPNPRPGKPSAPSLALGPSPGASPSWRAAPKASDLLG ARGPGGTFQGRDLRGGAHASSSSLNPMPPSQLQLSTV DAHARTPVLQVHPLESPAMISLTPPTTATGVFSLKAR PGLPPGINVASLEWVSREPALLCTFPNPSAPRKDSTL SAVPQSSYPLLANGVCKWPGCEKVFEEPEDFLKHCQA DHLLDEKGRAQCLLQREMVQSLEQQLVLEKEKLSAMQ AHLAGKMALTKASSVASSDKGSCCIVAAGSQGPVVPA WSGPREAPDSLFAVRRHLWGSHGNSTFPEFLHNMDYF KFHNMRPPFTYATLIRWAILEAPEKQRTLNEIYHWFT RMFAFFRNHPATWKNAIRHNLSLHKCFVRVESEKGAV WTVDELEFRKKRSQRPSRCSNPTPGP | 747 | 5727 |
| FOXP3 delta 2 | PNPRPGKPSAPSLALGPSPGASPSWRAAPKASDLLGA RGPGGTFQGRDLRGGAHASSSSLNPMPPSQLQLSTVD AHARTPVLQVHPLESPAMISLTPPTTATGVFSLKARP GLPPGINVASLEWVSREPALLCTFPNPSAPRKDSTLS AVPQSSYPLLANGVCKWPGCEKVFEEPEDFLKHCQAD HLLDEKGRAQCLLQREMVQSLEQQLVLEKEKLSAMQA HLAGKMALTKASSVASSDKGSCCIVAAGSQGPVVPAW SGPREAPDSLFAVRRHLWGSHGNSTFPEFLHNMDYFK FHNMRPPFTYATLIRWAILEAPEKQRTLNEIYHWFTR MFAFFRNHPATWKNAIRHNLSLHKCFVRVESEKGAVW TVDELEFRKKRSQRPSRCSNPTPGP | 748 | 5728 |

TABLE 41-continued

DD-FOXP3 constructs

| Construct Description | Amino Acid sequence | Amino Acid SEQ ID NO. | Nucleic Acid SEQ ID NO. |
|---|---|---|---|
| OT-FOXP3-001 (FoxP3-stop) | MPNPRPGKPSAPSLALGPSPGASPSWRAAPKASDLLG ARGPGGTFQGRDLRGGAHASSSSLNPMPPSQLQLPTL PLVMVAPSGARLGPLPHLQALLQDRPHFMHQLSTVDA HARTPVLQVHPLESPAMISLTPPTTATGVFSLKARPG LPPGINVASLEWVSREPALLCTFPNPSAPRKDSTLSA VPQSSYPLLANGVCKWPGCEKVFEEPEDFLKHCQADH LLDEKGRAQCLLQREMVQSLEQQLVLEKEKLSAMQAH LAGKMALTKASSVASSDKGSCCIVAAGSQGPVVPAWS GPREAPDSLFAVRRHLWGSHGNSTFPEFLHNMDYFKF HNMRPPFTYATLIRWAILEAPEKQRTLNEIYHWFTRM FAFFRNHPATWKNAIRHNLSLHKCFVRVESEKGAVWT VDELEFRKKRSQRPSRCSNPTPGP* | 1158 | 5729 |
| OT-FOXP3-002 (FoxP3 Delta 2-stop) | MPNPRPGKPSAPSLALGPSPGASPSWRAAPKASDLLG ARGPGGTFQGRDLRGGAHASSSSLNPMPPSQLQLSTV DAHARTPVLQVHPLESPAMISLTPPTTATGVFSLKAR PGLPPGINVASLEWVSREPALLCTFPNPSAPRKDSTL SAVPQSSYPLLANGVCKWPGCEKVFEEPEDFLKHCQA DHLLDEKGRAQCLLQREMVQSLEQQLVLEKEKLSAMQ AHLAGKMALTKASSVASSDKGSCCIVAAGSQGPVVPA WSGPREAPDSLFAVRRHLWGSHGNSTFPEFLHNMDYF KFHNMRPPFTYATLIRWAILEAPEKQRTLNEIYHWFT RMFAFFRNHPATWKNAIRHNLSLHKCFVRVESEKGAV WTVDELEFRKKRSQRPSRCSNPTPGP* | 1159 | 5730 |
| OT-FOXP3-003 (Met-FKBP (F36V, L106P)-Linker (SGGGS (SEQ ID NO: 3089))-Amino Acid 2-431 of FOXP3 full length-stop) | MGVQVETISPGDGRTFPKRGQTCVVHYTGMLEDGKKV DSSRDRNKPFKFMLGKQEVIRGWEEGVAQMSVGQRAK LTISPDYAYGATGHPGIIPPHATLVFDVELLKPESGG GSPNPRPGKPSAPSLALGPSPGASPSWRAAPKASDLL GARGPGGTFQGRDLRGGAHASSSSLNPMPPSQLQLPT LPLVMVAPSGARLGPLPHLQALLQDRPHFMHQLSTVD AHARTPVLQVHPLESPAMISLTPPTTATGVFSLKARP GLPPGINVASLEWVSREPALLCTFPNPSAPRKDSTLS AVPQSSYPLLANGVCKWPGCEKVFEEPEDFLKHCQAD HLLDEKGRAQCLLQREMVQSLEQQLVLEKEKLSAMQA HLAGKMALTKASSVASSDKGSCCIVAAGSQGPVVPAW SGPREAPDSLFAVRRHLWGSHGNSTFPEFLHNMDYFK FHNMRPPFTYATLIRWAILEAPEKQRTLNEIYHWFTR MFAFFRNHPATWKNAIRHNLSLHKCFVRVESEKGAVW TVDELEFRKKRSQRPSRCSNPTPGP* | 1160 | 5731 |
| OT-FOXP3-004 (ecDHFR (R12Y, Y100I)-Linker (SGGGS (SEQ ID NO: 3089))-Amino Acid 2-431 of FOXP3 full length-stop) | MISLIAALAVDYVIGMENAMPWNLPADLAWFKRNTLN KPVIMGRHTWESIGRPLPGRKNIILSSQPGTDDRVTW VKSVDEAIAACGDVPEIMVIGGGRVIEQFLPKAQKLY LTHIDAEVEGDTHFPDYEPDDWESVFSEFHDADAQNS HSYCFEILERRSGGGSPNPRPGKPSAPSLALGPSPGA SPSWRAAPKASDLLGARGPGGTFQGRDLRGGAHASSS SLNPMPPSQLQLPTLPLVMVAPSGARLGPLPHLQALL QDRPHFMHQLSTVDAHARTPVLQVHPLESPAMISLTP PTTATGVFSLKARPGLPPGINVASLEWVSREPALLCT FPNPSAPRKDSTLSAVPQSSYPLLANGVCKWPGCEKV FEEPEDFLKHCQADHLLDEKGRAQCLLQREMVQSLEQ QLVLEKEKLSAMQAHLAGKMALTKASSVASSDKGSCC IVAAGSQGPVVPAWSGPREAPDSLFAVRRHLWGSHGN STFPEFLHNMDYFKFHNMRPPFTYATLIRWAILEAPE KQRTLNEIYHWFTRMFAFFRNHPATWKNAIRHNLSLH KCFVRVESEKGAVWTVDELEFRKKRSQRPSRCSNPTP GP* | 1161 | 5732 |
| OT-FOXP3-005 (FoxP3-Linker (SG)-FKBP (E31G, F36V, R71G, K105E)-stop) | MPNPRPGKPSAPSLALGPSPGASPSWRAAPKASDLLG ARGPGGTFQGRDLRGGAHASSSSLNPMPPSQLQLPTL PLVMVAPSGARLGPLPHLQALLQDRPHFMHQLSTVDA HARTPVLQVHPLESPAMISLTPPTTATGVFSLKARPG LPPGINVASLEWVSREPALLCTFPNPSAPRKDSTLSA VPQSSYPLLANGVCKWPGCEKVFEEPEDFLKHCQADH LLDEKGRAQCLLQREMVQSLEQQLVLEKEKLSAMQAH LAGKMALTKASSVASSDKGSCCIVAAGSQGPVVPAWS GPREAPDSLFAVRRHLWGSHGNSTFPEFLHNMDYFKF HNMRPPFTYATLIRWAILEAPEKQRTLNEIYHWFTRM FAFFRNHPATWKNAIRHNLSLHKCFVRVESEKGAVWT VDELEFRKKRSQRPSRCSNPTPGPSGGVQVETISPGD GRTFPKRGQTCVVHYTGMLGDGKKVDSSRDRNKPFKF MLGKQEVIRGWEEGVAQMSVGQGAKLTISPDYAYGAT GHPGIIPPHATLVFDVELLELE* | 1162 | 5733 |

TABLE 41-continued

| DD-FOXP3 constructs | | | |
|---|---|---|---|
| Construct Description | Amino Acid sequence | Amino Acid SEQ ID NO. | Nucleic Acid SEQ ID NO. |
| OT-FOXP3-006 (FoxP3-Linker (SG)-ecDHFR (Amino acid 2-159 of WT) (R12Y, Y100I)-stop) | MPNPRPGKPSAPSLALGPSPGASPSWRAAPKASDLLG ARGPGGTFQGRDLRGGAHASSSSLNPMPPSQLQLPTL PLVMVAPSGARLGPLPHLQALLQDRPHFMHQLSTVDA HARTPVLQVHPLESPAMISLTPPTTATGVFSLKARPG LPPGINVASLEWVSREPALLCTFPNPSAPRKDSTLSA VPQSSYPLLANGVCKWPGCEKVFEEPEDFLKHCQADH LLDEKGRAQCLLQREMVQSLEQQLVLEKEKLSAMQAH LAGKMALTKASSVASSDKGSCCIVAAGSQGPVVPAWS GPREAPDSLFAVRRHLWGSHGNSTFPEFLHNMDYFKF HNMRPPFTYATLIRWAILEAPEKQRTLNEIYHWFTRM FAFFRNHPATWKNAIRHNLSLHKCFVRVESEKGAVWT VDELEFRKKRSQRPSRCSNPTPGPSGISLIAALAVDY VIGMENAMPWNLPADLAWFKRNTLNKPVIMGRHTWES IGRPLPGRKNIILSSQPGTDDRVTWVKSVDEAIAACG DVPEIMVIGGGRVIEQFLPKAQKLYLTHIDAEVEGDT HFPDYEPDDWESVFSEFHDADAQNSHSYCFEILERR* | 1163 | 5734 |
| OT-FOXP3-007 (Met-FKBP (F36V, L106P)-Linker (SG)-Amino Acid 2-396 of FOXP3 delta 2-stop) | MGVQVETISPGDGRTFPKRGQTCVVHYTGMLEDGKKV DSSRDRNKPFKFMLGKQEVIRGWEEGVAQMSVGQRAK LTISPDYAYGATGHPGIIPPHATLVFDVELLKPESGP NPRPGKPSAPSLALGPSPGASPSWRAAPKASDLLGAR GPGGTFQGRDLRGGAHASSSSLNPMPPSQLQLSTVDA HARTPVLQVHPLESPAMISLTPPTTATGVFSLKARPG LPPGINVASLEWVSREPALLCTFPNPSAPRKDSTLSA VPQSSYPLLANGVCKWPGCEKVFEEPEDFLKHCQADH LLDEKGRAQCLLQREMVQSLEQQLVLEKEKLSAMQAH LAGKMALTKASSVASSDKGSCCIVAAGSQGPVVPAWS GPREAPDSLFAVRRHLWGSHGNSTFPEFLHNMDYFKF HNMRPPFTYATLIRWAILEAPEKQRTLNEIYHWFTRM FAFFRNHPATWKNAIRHNLSLHKCFVRVESEKGAVWT VDELEFRKKRSQRPSRCSNPTPGP* | 1164 | 5735 |
| OT-FOXP3-008 (ecDHFR (R12Y, Y100I)-Linker (SG)-Amino Acid 2-396 of FOXP3 delta 2-stop) | MISLIAALAVDYVIGMENAMPWNLPADLAWFKRNTLN KPVIMGRHTWESIGRPLPGRKNIILSSQPGTDDRVTW VKSVDEAIAACGDVPEIMVIGGGRVIEQFLPKAQKLY LTHIDAEVEGDTHFPDYEPDDWESVFSEFHDADAQNS HSYCFEILERRSGPNPRPGKPSAPSLALGPSPGASPS WRAAPKASDLLGARGPGGTFQGRDLRGGAHASSSSLN PMPPSQLQLSTVDAHARTPVLQVHPLESPAMISLTPP TTATGVFSLKARPGLPPGINVASLEWVSREPALLCTF PNPSAPRKDSTLSAVPQSSYPLLANGVCKWPGCEKVF EEPEDFLKHCQADHLLDEKGRAQCLLQREMVQSLEQQ LVLEKEKLSAMQAHLAGKMALTKASSVASSDKGSCCI VAAGSQGPVVPAWSGPREAPDSLFAVRRHLWGSHGNS TFPEFLHNMDYFKFHNMRPPFTYATLIRWAILEAPEK QRTLNEIYHWFTRMFAFFRNHPATWKNAIRHNLSLHK CFVRVESEKGAVWTVDELEFRKKRSQRPSRCSNPTPG P* | 1165 | 5736 |
| OT-FOXP3-009 (FoxP3 Delta 2-Linker (SG)-FKBP(E31 G, F36V, R71G, K105E)-stop) | MPNPRPGKPSAPSLALGPSPGASPSWRAAPKASDLLG ARGPGGTFQGRDLRGGAHASSSSLNPMPPSQLQLSTV DAHARTPVLQVHPLESPAMISLTPPTTATGVFSLKAR PGLPPGINVASLEWVSREPALLCTFPNPSAPRKDSTL SAVPQSSYPLLANGVCKWPGCEKVFEEPEDFLKHCQA DHLLDEKGRAQCLLQREMVQSLEQQLVLEKEKLSAMQ AHLAGKMALTKASSVASSDKGSCCIVAAGSQGPVVPA WSGPREAPDSLFAVRRHLWGSHGNSTFPEFLHNMDYF KFHNMRPPFTYATLIRWAILEAPEKQRTLNEIYHWFT RMFAFFRNHPATWKNAIRHNLSLHKCFVRVESEKGAV WTVDELEFRKKRSQRPSRCSNPTPGPSGGVQVETISP GDGRTFPKRGQTCVVHYTGMLGDGKKVDSSRDRNKPF KFMLGKQEVIRGWEEGVAQMSVGQGAKLTISPDYAYG ATGHPGIIPPHATLVFDVELLELE* | 1166 | 5737 |
| OT-FOXP3-010 (FoxP3 Delta 2-Linker (SG)-ecDHFR (Amino acid 2-159 of WT) (R12Y, Y100I)-stop) | MPNPRPGKPSAPSLALGPSPGASPSWRAAPKASDLLG ARGPGGTFQGRDLRGGAHASSSSLNPMPPSQLQLSTV DAHARTPVLQVHPLESPAMISLTPPTTATGVFSLKAR PGLPPGINVASLEWVSREPALLCTFPNPSAPRKDSTL SAVPQSSYPLLANGVCKWPGCEKVFEEPEDFLKHCQA DHLLDEKGRAQCLLQREMVQSLEQQLVLEKEKLSAMQ AHLAGKMALTKASSVASSDKGSCCIVAAGSQGPVVPA WSGPREAPDSLFAVRRHLWGSHGNSTFPEFLHNMDYF KFHNMRPPFTYATLIRWAILEAPEKQRTLNEIYHWFT RMFAFFRNHPATWKNAIRHNLSLHKCFVRVESEKGAV WTVDELEFRKKRSQRPSRCSNPTPGPSGISLIAALAV | 1167 | 5738 |

TABLE 41-continued

DD-FOXP3 constructs

| Construct Description | Amino Acid sequence | Amino Acid SEQ ID NO. | Nucleic Acid SEQ ID NO. |
|---|---|---|---|
| | DYVIGMENAMPWNLPADLAWFKRNTLNKPVIMGRHTW ESIGRPLPGRKNIILSSQPGTDDRVTWVKSVDEAIAA CGDVPEIMVIGGGRVIEQFLPKAQKLYLTHIDAEVEG DTHFPDYEPDDWESVFSEFHDADAQNSHSYCFEILER R* | | |

In some embodiments, the SREs of the present invention may be used to achieve pulsatile expression of the compositions of the invention. As used here, "pulsatile" refers to a plurality of payload expression at spaced apart time intervals. Generally, upon administration of the stimulus, the expression of the payload is increased causing the first pulse; following the withdrawal of the stimulus, the expression of the payload decreases and this represents the interval time between the first exposure and the next exposure to the stimulus, after which the second exposure to the stimulus is initiated. Compositions of the invention may be used in varying doses to avoid T cell energy, prevent cytokine release syndrome and minimize toxicity associated with immunotherapy. For example, low doses of the compositions of the present invention may be used to initially treat patients with high tumor burden, while patients with low tumor burden may be treated with high and repeated doses of the compositions of the invention to ensure recognition of a minimal tumor antigen load. In another instance, the compositions of the present invention may be delivered in a pulsatile fashion to reduce tonic T cell signaling and enhance persistence in vivo. In some aspects, toxicity may be minimized by initially using low doses of the compositions of the invention, prior to administering high doses. Dosing may be modified if serum markers such as ferritin, serum C-reactive protein, IL6, IFN-γ, and TNF-α are elevated. Doses for pulsatile expression may be spaced apart in time intervals measured in seconds, hours, days, or months.

5. Genomic Editing Systems

In some embodiments, payloads of the present invention may be components of gene editing systems including a CRISPR (Clustered Regularly Interspaced Short Palindromic Repeats), CRISPR enzyme (Cas9), CRISPR-Cas9 or CRISPR system and CRISPR-CAS9 complex. It may also be other genomic editing systems, such as Zinc finger nucleases, TALEN (Transcription activator-like effector-based nucleases) and meganucleases.

Additional Features

The effector module of the present invention may further comprise a signal sequence which regulates the distribution of the payload of interest, a cleavage and/or processing feature which facilitate cleavage of the payload from the effector module construct, a targeting and/or penetrating signal which can regulate the cellular localization of the effector module, a tag, and/or one or more linker sequences which link different components (e.g. a DD and a payload) of the effector module.

1. Signal Sequences

In addition to the SRE (e.g., DD) and payload region, effector modules of the invention may further comprise one or more signal sequences. Signal sequences (sometimes referred to as signal peptides, targeting signals, target peptides, localization sequences, transit peptides, leader sequences or leader peptides) direct proteins (e.g., the effector module of the present invention) to their designated cellular and/or extracellular locations. Protein signal sequences play a central role in the targeting and translocation of nearly all secreted proteins and many integral membrane proteins.

A signal sequence is a short (5-30 amino acids long) peptide present at the N-terminus of the majority of newly synthesized proteins that are destined towards a particular location. Signal sequences can be recognized by signal recognition particles (SRPs) and cleaved using type I and type II signal peptide peptidases. Signal sequences derived from human proteins can be incorporated as a regulatory module of the effector module to direct the effector module to a particular cellular and/or extracellular location. These signal sequences are experimentally verified and can be cleaved (Zhang et al., Protein Sci. 2004, 13:2819-2824).

In some embodiments, a signal sequence may be, although not necessarily, located at the N-terminus or C-terminus of the effector module, and may be, although not necessarily, cleaved off the desired effector module to yield a "mature" payload, i.e., an immunotherapeutic agent as discussed herein.

In some examples, a signal sequence may be a secreted signal sequence derived from a naturally secreted protein, and its variant thereof. In some instances, the secreted signal sequences may be cytokine signal sequences such as, but not limited to, IL2 signal sequence comprising amino acid of SEQ ID NO. 2956, encoded by the nucleotide of SEQ ID NOs. 5739-5742 and/or p40 signal sequence comprising the amino acid sequence of SEQ ID NO. 2219, encoded by the nucleotide of SEQ ID NOs. 2219-2229 or a GMCSF leader sequence comprising the amino acid sequence of SEQ ID NOs. 5758-5760.

In some examples, a signal sequence may be a secreted signal sequence derived from a naturally secreted protein, and its variant thereof. In some instances, the secreted signal sequences may be cytokine signal sequences such as, but not limited to, L2 signal sequence comprising amino acid of SEQ. ID NO. 2801, encoded by the nucleotide of SEQ. ID NO. 1561-5764 and/or p40 signal sequence comprising the amino acid sequence of SEQ. ID NO. 5765, encoded by the nucleotide of SEQ. ID NO. 5766-5774.

In some examples, a signal sequence may be a secreted signal sequence derived from a naturally secreted protein, and its variant thereof. In some instances, the secreted signal sequences may be cytokine signal sequences such as, but not limited to, L2 signal sequence (amino acid of SEQ ID NO. 2776, encoded by the nucleic acid sequence of SEQ ID NO. 5775, 5776 and/or 5777, 5778), p40 signal sequence (amino acid sequence of SEQ ID NO. 5779, encoded by the nucleic acid sequence of SEQ ID NO. 5780-5788), or a GMCSF leader sequence (SEQ ID NO. 2762 (encoded by SEQ ID NO. 5789), 5790, 5791).

In some instances, signal sequences directing the payload to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence comprising amino acid SEQ ID NO. 2957 and nucleotide sequence of SEQ ID NO. 5792, a CD8a signal sequence comprising amino acid SEQ ID NO. 1320 and nucleotide sequence of SEQ ID NOs. 5793-5797, 5798-5800 or an IL15Ra signal sequence, comprising amino acid SEQ ID NO. 5801 encoded by SEQ ID NO. 5802.

In some instances, signal sequences directing the payload of interest to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload of interest. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence comprising amino acid SEQ. ID NO. 2802 and nucleotide sequence of SEQ. ID NO. 5803, 5804, or 5805, an IL15Ra signal sequence comprising amino acid SEQ. ID NO. 2882 and nucleotide sequence of SEQ. ID NO. 5806, or CD8a signal sequence (also referred to as CD8a leader) comprising amino acid SEQ. ID NO. 5807 and nucleotide sequence of SEQ. ID NO. 5808-5812.

In some instances, signal sequences directing the payload of interest to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload of interest. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence (amino acid SEQ ID NO. 5813 and nucleotide sequence of SEQ ID NO. 5814), CD8a signal sequence (also referred to as CD8a leader) (amino acid SEQ ID NO. 2766 and nucleotide sequence of SEQ ID NO. 5815-5819, and/or 5820) or an IL15Ra signal sequence (amino acid SEQ ID NO. 5821, encoded by SEQ ID NO. 5822).

Other examples of signal sequences include, a variant may be a modified signal sequence discussed in U.S. Pat. Nos. 8,148,494, 8,258,102, 9,133,265, 9,279,007, and U.S. Patent Application Publication No. 2007/0141666; and International Patent Publication NO. WO 1993/018181; the contents of each of which are incorporated herein by reference in their entirety. In other examples, a signal sequence may be a heterogeneous signal sequence from other organisms such as virus, yeast and bacteria, which can direct an effector module to a particular cellular site, such as a nucleus (e.g., EP 1209450). Other examples may include Aspartic Protease (NSP24) signal sequences from *Trichoderma* that can increase secretion of fused protein such as enzymes (e.g., U.S. Pat. No. 8,093,016 to Cervin and Kim), bacterial lipoprotein signal sequences (e.g., International Patent Publication NO. WO1991/09952 to Lau and Rioux), *E. coli* enterotoxin II signal peptides (e.g., U.S. Pat. No. 6,605,697 to Kwon et al.), *E. coli* secretion signal sequence (e.g., U.S. Patent Publication NO. 2016/090404 to Malley et al.), a lipase signal sequence from a methylotrophic yeast (e.g., U.S. Pat. No. 8,975,041), and signal peptides for DNases derived from Coryneform bacteria (e.g., U.S. Pat. No. 4,965, 197); the contents of each of which are incorporated herein by reference in their entirety.

Signal sequences may also include nuclear localization signals (NLSs), nuclear export signals (NESs), polarized cell tubulo-vesicular structure localization signals (See, e.g., U.S. Pat. No. 8,993,742; Cour et al., *Nucleic Acids Res.* 2003, 31(1): 393-396; the contents of each of which are incorporated herein by reference in their entirety), extracellular localization signals, signals to subcellular locations (e.g. lysosome, endoplasmic reticulum, golgi, mitochondria, plasma membrane and peroxisomes, etc.) (See, e.g., U.S. Pat. No. 7,396,811; and Negi et al., *Database,* 2015, 1-7; the contents of each of which are incorporated herein by reference in their entirety).

In some embodiments, signal sequences of the present invention, include without limitation, any of those taught in Tables 6 or 7 of copending commonly owned U.S. Provisional Patent Application No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

In some examples, a signal sequence may be a secreted signal sequence derived from a naturally secreted protein, and its variant thereof. In some instances, the secreted signal sequences may be cytokine signal sequences such as, but not limited to, IL2 signal sequence comprising amino acid of SEQ ID NO: 2793, encoded by the nucleotide of SEQ ID NO: 5823-5826 and/or p40 signal sequence comprising the amino acid sequence of SEQ ID NO: 2748, encoded by the nucleotide of SEQ ID NO: 5827-5835.

In some instances, signal sequences directing the payload of interest to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload of interest. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence comprising amino acid SEQ ID NO: 2794 and nucleotide sequence of SEQ ID NO: 5836, 5837, or 5838, CD8a signal sequence (also referred to as CD8a leader) comprising amino acid SEQ ID NO: 2747 and nucleotide sequence of SEQ ID NO: 5839-5843, or IL15Ra signal sequence (also referred to as IL15Ra leader) comprising amino acid SEQ ID NO: 2815 and nucleotide sequence of SEQ ID NO: 5844.

Other examples of signal sequences include, a variant may be a modified signal sequence discussed in U.S. Pat. Nos. 8,148,494; 8,258,102; 9,133,265; 9,279,007; and U.S. patent application publication NO.: 20070141666; and International patent application publication NO.: WO1993018181; the contents of each of which are incorporated herein by reference in their entirety.

In other examples, a signal sequence may be a heterogeneous signal sequence from other organisms such as virus, yeast and bacteria, which can direct an effector module to a particular cellular site, such as a nucleus (e.g., EP 1209450). Other examples may include Aspartic Protease (NSP24) signal sequences from *Trichoderma* that can increase secretion of fused protein such as enzymes (e.g., U.S. Pat. No. 8,093,016 to Cervin and Kim), bacterial lipoprotein signal sequences (e.g., PCT application publication NO.: WO199109952 to Lau and Rioux), *E. coli* enterotoxin II signal peptides (e.g., U.S. Pat. No. 6,605,697 to Kwon et al.), *E. coli* secretion signal sequence (e.g., U.S. patent publication NO.: US2016090404 to Malley et al.), a lipase signal sequence from a methylotrophic yeast (e.g., U.S. Pat. No. 8,975,041), and signal peptides for DNases derived from Coryneform bacteria (e.g., U.S. Pat. No. 4,965,197); the contents of each of which are incorporated herein by reference in their entirety.

Signal sequences may also include nuclear localization signals (NLSs), nuclear export signals (NESs), polarized cell tubulo-vesicular structure localization signals (See, e.g., U.S. Pat. No. 8,993,742; Cour et al., *Nucleic Acids Res.* 2003, 31(1): 393-396; the contents of each of which are incorporated herein by reference in their entirety), extracellular localization signals, signals to subcellular locations (e.g. lysosome, endoplasmic reticulum, golgi, mitochondria, plasma membrane and peroxisomes, etc.) (See, e.g., U.S. Pat. No. 7,396,811; and Negi et al., *Database,* 2015, 1-7; the contents of each of which are incorporated herein by reference in their entirety).

In some embodiments, signal sequences of the present invention, include without limitation, any of those taught in Tables 6 or 7 of copending commonly owned U.S. Provisional Patent Application No. 62/320,864 filed on Apr. 11, 2016, or in U.S. Provisional Application No. 62/466,596 filed Mar. 3, 2017 and the International Publication WO2017/180587, the contents of each of which are incorporated herein by reference in their entirety.

In some embodiments, signal sequences of the present invention, include without limitation, any of those taught in Table 7 of copending commonly owned U.S. Provisional Patent Application No. 62/320,864, filed on Apr. 11, 2016, or in U.S. Provisional Application No. 62/466,596 filed Mar. 3, 2017 and the International Publication WO2017/180587, the contents of which are incorporated herein by reference in their entirety.

In addition to the SRE (e.g., DD) and payload region, effector modules of the invention may further comprise one or more signal sequences. Signal sequences (sometimes referred to as signal peptides, targeting signals, target peptides, localization sequences, transit peptides, leader sequences or leader peptides) direct proteins (e.g., the effector module of the present invention) to their designated cellular and/or extracellular locations. Protein signal sequences play a central role in the targeting and translocation of nearly all secreted proteins and many integral membrane proteins.

Protein Tags

In some embodiments, the effector module of the invention may comprise a protein tag. The protein tag may be used for detecting and monitoring the process of the effector module. The effector module may include one or more tags such as an epitope tag (e.g., a FLAG or hemagglutinin (HA) tag). A large number of protein tags may be used for the present effector modules. They include, but are not limited to, self-labeling polypeptide tags (e.g., haloalkane dehalogenase (halotag2 or halotag7), ACP tag, clip tag, MCP tag, snap tag), epitope tags (e.g., FLAG, HA, His, and Myc), fluorescent tags (e.g., green fluorescent protein (GFP), red fluorescent protein (RFP), yellow fluorescent protein (YFP), and its variants), bioluminescent tags (e.g. luciferase and its variants), affinity tags (e.g., maltose-binding protein (MBP) tag, glutathione-S-transferase (GST) tag), immunogenic affinity tags (e.g., protein A/G, IRS, AU1, AU5, glu-glu, KT3, S-tag, HSV, VSV-G, Xpress and V5), and other tags (e.g., biotin (small molecule), StrepTag (StrepII), SBP, biotin carboxyl carrier protein (BCCP), eXact, CBP, CYD, HPC, CBD intein-chitin binding domain, Trx, NorpA, and NusA.

In other embodiments, a tag may also be selected from those disclosed in U.S. Pat. Nos. 8,999,897; 8,357,511; 7,094, 568; 5,011,912; 4,851,341; and 4,703,004; U.S patent application publication NOs.: US2013115635 and US2013012687; and International application publication NO.: WO2013091661; the contents of each of which are incorporated herein by reference in their entirety.

In some aspects, a multiplicity of protein tags, either the same or different tags, may be used; each of the tags may be located at the same N- or C-terminus, whereas in other cases these tags may be located at each terminus.

In some embodiments, protein tags of the present invention, include without limitation, any of those taught in Table 8 of copending commonly owned U.S. Provisional Patent Application No. 62/320,864 filed on Apr. 11, 2016, or in U.S. Provisional Application No. 62/466,596 filed Mar. 3, 2017 and the International Publication WO2017/180587, the contents of each of which are incorporated herein by reference in their entirety.

2. Cleavage Sites

In some embodiments, the effector module comprises a cleavage and/or processing feature. The effector module of the present invention may include at least one protein cleavage signal/site. The protein cleavage signal/site may be located at the N-terminus, the C-terminus, at any space between the N- and the C-termini such as, but not limited to, half-way between the N- and C-termini, between the N-terminus and the half-way point, between the half-way point and the C-terminus, and combinations thereof.

The effector module may include one or more cleavage signal(s)/site(s) of any proteinases. The proteinases may be a serine proteinase, a cysteine proteinase, an endopeptidase, a dipeptidase, a metalloproteinase, a glutamic proteinase, a threonine proteinase and an aspartic proteinase. In some aspects, the cleavage site may be a signal sequence of furin, actinidain, calpain-1, carboxypeptidase A, carboxypeptidase P, carboxypeptidase Y, caspase-1, caspase-2, caspase-3, caspase-4, caspase-5, caspase-6, caspase-7, caspase-8, caspase-9, caspase-10, cathepsin B, cathepsin C, cathepsin G, cathepsin H, cathepsin K, cathepsin L, cathepsin S, cathepsin V, clostripain, chymase, chymotrypsin, elastase, endoproteinase, enterokinase, factor Xa, formic acid, granzyme B, Matrix metallopeptidase-2, Matrix metallopeptidase-3, pepsin, proteinase K, SUMO protease, subtilisin, TEV protease, thermolysin, thrombin, trypsin and TAGZyme.

In one embodiment, the cleavage site is a furin cleavage site comprising the amino acid sequence SARNRQKRS (SEQ ID NO. 2984), encoded by nucleotide sequence of SEQ ID NO. 5845), or a revised furin cleavage site comprising the amino acid sequence ARNRQKRS (SEQ ID NO. 2985), encoded by nucleotide sequence of SEQ ID NO. 5846); or a modified furin site comprising the amino acid sequence ESRRVRRNKRSK (SEQ ID NO. 3079), encoded by nucleotide sequence of SEQ ID NO. 5847-5849); or a SGESRRVRRNKRSK (SEQ ID NO. 2986), encoded by the nucleotide sequence of SEQ ID NO. 5850. In some instances, the cleavage site is a P2A cleavage site, ATNFSLLKQAGDVEENPGP (SEQ ID NO. 2987), encoded by SEQ ID NO. 5851, wherein NPGP (SEQ ID NO. 2988) is the P2A site.

In one embodiment, the cleavage site is a furin cleavage site comprising the amino acid sequence SARNRQKRS (SEQ ID NO. 2989), encoded by nucleotide sequence of SEQ ID NO. 5852; or a revised furin cleavage site comprising the amino acid sequence ARNRQKRS (SEQ ID NO. 2990), encoded by nucleotide sequence of SEQ ID NO. 5853; modified furin site comprising the amino acid sequence ESRRVRRNKRSK (SEQ ID NO. 3083), encoded by nucleotide sequence of SEQ ID NO. 5854-5856; or a SGESRRVRRNKRSK (SEQ ID NO. 2991), encoded by the nucleotide sequence of SEQ ID NO. 5857. In some instances, the cleavage site is a P2A cleavage site ATNFSLLKQAGDVEENPGP (SEQ ID NO. 2992), encoded by SEQ ID NO. 5858, or GATNFSLLKQAGD-VEENPGP (SEQ ID NO. 2993), encoded by SEQ ID NO. 5859), wherein NPGP (SEQ ID NO. 2994) is the P2A site.

In one embodiment, the cleavage site is a furin cleavage site comprising the amino acid sequence SARNRQKRS (SEQ. ID NO. 2995), encoded by nucleotide sequence of SEQ. ID NO. 5860; or a revised furin cleavage site comprising the amino acid sequence ARNRQKRS (SEQ. ID NO. 2996), encoded by nucleotide sequence of SEQ. ID NO. 5861; or a modified furin site comprising the amino acid sequence ESRRVRRNKRSK (SEQ. ID NO. 2997), encoded by nucleotide sequence of SEQ. ID NO. 5862-5864.

In some embodiments, cleavage sites of the present invention, include without limitation, any of those taught in Table 7 of copending commonly owned U.S. Provisional Patent Application No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

3. Protein Tags

In some embodiments, the effector module of the invention may comprise a protein tag. The protein tag may be used for detecting and monitoring the process of the effector module. The effector module may include one or more tags such as an epitope tag (e.g., a FLAG or hemagglutinin (HA) tag). A large number of protein tags may be used for the present effector modules. They include, but are not limited to, self-labeling polypeptide tags (e.g., haloalkane dehalogenase (halotag2 or halotag7), ACP tag, clip tag, MCP tag, snap tag), epitope tags (e.g., FLAG, HA, His, and Myc), fluorescent tags (e.g., green fluorescent protein (GFP), red fluorescent protein (RFP), yellow fluorescent protein (YFP), and its variants), bioluminescent tags (e.g. luciferase and its variants), affinity tags (e.g., maltose-binding protein (MBP) tag, glutathione-S-transferase (GST) tag), immunogenic affinity tags (e.g., protein A/G, IRS, AU1, AU5, glu-glu, KT3, S-tag, HSV, VSV-G, Xpress and V5), and other tags (e.g., biotin (small molecule), StrepTag (StrepII), SBP, biotin carboxyl carrier protein (BCCP), eXact, CBP, CYD, HPC, CBD intein-chitin binding domain, Trx, NorpA, and NusA.

In other embodiments, a tag may also be selected from those disclosed in U.S. Pat. Nos. 8,999,897, 8,357,511, 7,094,568, 5,011,912, 4,851,341, and 4,703,004; U.S Patent Application Publication NOs. 2013/115635 and 2013/012687; and International Patent Publication NO. WO2013/091661; the contents of each of which are incorporated herein by reference in their entirety.

In other embodiments, a tag may also be selected from those disclosed in U.S. Pat. Nos. 8,999,897; 8,357,511; 7,094, 568; 5,011,912; 4,851,341; and 4,703,004; U.S patent application publication NOs. US2013115635 and US2013012687; and International application publication NOS. WO2013091661; the contents of each of which are incorporated herein by reference in their entirety.

In some aspects, a multiplicity of protein tags, either the same or different tags, may be used; each of the tags may be located at the same N- or C-terminus, whereas in other cases these tags may be located at each terminus.

In one embodiment, the protein tag is an HA tag. A non-limiting example of an HA tag is YPYDVPDYA (SEQ ID NO. 2998, encoded by SEQ ID NO. 5865, 5866, and/or 5867).

In some embodiments, protein tags of the present invention, include without limitation, any of those taught in Table 8 of copending commonly owned U.S. Provisional Patent Application No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

4. Targeting Peptides

In some embodiments, the effector module of the invention may further comprise a targeting and/or penetrating peptide. Small targeting and/or penetrating peptides that selectively recognize cell surface markers (e.g. receptors, trans-membrane proteins, and extra-cellular matrix molecules) can be employed to target the effector module to the desired organs, tissues or cells. Short peptides (5-50 amino acid residues) synthesized in vitro and naturally occurring peptides, or analogs, variants, derivatives thereof, may be incorporated into the effector module for homing the effector module to the desired organs, tissues and cells, and/or subcellular locations inside the cells.

In some embodiments, a targeting sequence and/or penetrating peptide may be included in the effector module to drive the effector module to a target organ, or a tissue, or a cell (e.g., a cancer cell). In other embodiments, a targeting and/or penetrating peptide may direct the effector module to a specific subcellular location inside a cell.

A targeting peptide has any number of amino acids from about 6 to about 30 inclusive. The peptide may have 6, 7, 8, 9, 10, 11, 12, 13, 14, 15, 16, 17, 18, 19, 20, 21, 22, 23, 24, 25, 26, 27, 28, 29 or 30 amino acids. Generally, a targeting peptide may have 25 or fewer amino acids, for example, 20 or fewer, for example 15 or fewer.

Exemplary targeting peptides may include, but are not limited to, those disclosed in the art, e.g., U.S. Pat. Nos. 9,206,231, 9,110,059, 8,706,219, and 8,772,449; and U.S. Patent Application Publication Nos. 2016/089447, 2016/060296, 2016/060314, 2016/060312, 2016/060311, 2016/009772, 2016/002613, 2015/314011 and 2015/166621; and International Patent Publication Nos. WO2015/179691 and WO2015/183044; the contents of each of which are incorporated herein by reference in their entirety. In some embodiments, targeting peptides of the present invention, include without limitation, any of those taught in Table 9 of copending commonly owned U.S. Provisional Patent Application No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

5. Linkers

In some embodiments, the effector module of the invention may further comprise a linker sequence. The linker region serves primarily as a spacer between two or more polypeptides within the effector module. The "linker" or "spacer", as used herein, refers to a molecule or group of molecules that connects two molecules, or two parts of a molecule such as two domains of a recombinant protein.

In some embodiments, "Linker" (L) or "linker domain" or "linker region" or "linker module" or "peptide linker" as used herein refers to an oligo- or polypeptide region of from about 1 to 100 amino acids in length, which links together any of the domains/regions of the effector module (also called peptide linker). The peptide linker may be 1-40 amino acids in length, or 2-30 amino acids in length, or 20-80 amino acids in length, or 50-100 amino acids in length. Linker length may also be optimized depending on the type of payload utilized and based on the crystal structure of the payload. In some instances, a shorter linker length may be preferably selected. In some aspects, the peptide linker is made up of amino acids linked together by peptide bonds, preferably from 1 to 20 amino acids linked by peptide bonds, wherein the amino acids are selected from the 20 naturally occurring amino acids: Glycine (G), Alanine (A), Valine (V), Leucine (L), Isoleucine (I), Serine (S), Cysteine (C), Threonine (T), Methionine (M), Proline (P), Phenylalanine (F), Tyrosine (Y), Tryptophan (W), Histidine (H), Lysine (K), Arginine (R), Aspartate (D), Glutamic acid (E), Asparagine (N), and Glutamine (Q). One or more of these amino acids may be glycosylated, as is understood by those in the art. In some aspects, amino acids of a peptide linker may be selected from Alanine (A), Glycine (G), Proline (P), Asparagine (R), Serine (S), Glutamine (Q) and Lysine (K).

In one example, an artificially designed peptide linker may preferably be composed of a polymer of flexible residues like Glycine (G) and Serine (S) so that the adjacent protein domains are free to move relative to one another. Longer linkers may be used when it is desirable to ensure that two adjacent domains do not interfere with one another. The choice of a particular linker sequence may concern if it affects biological activity, stability, folding, targeting and/or pharmacokinetic features of the fusion construct. Examples of peptide linkers include, but are not limited to. SG, MH, GGSG (SEQ ID NO. 2999; encoded by the nucleotide sequence SEQ ID NO 5868), GGSGG (SEQ ID NO. 3078; encoded by any of the nucleotide sequences SEQ ID NO. 5869-5873), GGSGGG (SEQ ID NO. 1183; encoded by any of the nucleotide sequences SEQ ID NO. 5874-5875), SGGGS (SEQ ID NO. 2971; encoded by the nucleotide sequence SEQ ID NO. 5876), GGSGGGSGG (SEQ ID NO. 3038; encoded by the nucleotide sequence SEQ ID NO. 5877), GGGGG (SEQ ID NO. 3000), GGGGS (SEQ ID NO. 3002) or (GGGGS)n (n=1 (SEQ ID NO. 3002), 2 (SEQ ID NO. 3003), 3 (SEQ ID NO. 3004), 4 (SEQ ID NO. 3005), 5 (SEQ ID NO 3006), or 6 (SEQ ID NO. 3007)), SSSSG (SEQ ID NO. 3008) or (SSSSG)n (n=1 (SEQ ID NO. 3008), 2 (SEQ ID NO. 3009), 3 (SEQ ID NO. 3010), 4 (SEQ ID NO. 3011), 5 (SEQ ID NO. 3012), or 6 (SEQ ID NO. 3013)), SGGGSGGGGSGGGGSGGGGSGGGSLQ (SEQ ID NO. 2960; encoded by the nucleotide sequence SEQ ID NO. 5878), EFSTEF (SEQ ID NO. 3014 encoded by any of the nucleotide sequences SEQ ID NO. 5879-5880), SGGGS (SEQ ID NO. 3015; encoded by the nucleotide sequence SEQ ID NO. 5881), GKSSGSGSESKS (SEQ ID NO. 3016), GGSTSGSGKSSEGKG (SEQ ID NO. 3017), GST-SGSGKSSSEGSGSTKG (SEQ ID NO. 3018), GST-SGSGKPGSGEGSTKG (SEQ ID NO. 3019), VDY-PYDVPDYALD (SEQ ID NO. 3020; encoded by nucleotide sequence SEQ ID NO. 5882), EGKSSGSGSESKEF (SEQ ID NO. 3021), SG3-(SG4)3-SG3-SLQ-YPYDVPDYA (SEQ ID NO. 3022), encoded by the nucleotide sequence of SEQ ID NO. 5883; DYKDDDDK (SEQ ID NO. 3023), encoded by the nucleotide sequence of SEQ ID NO. 5884; SG3-(SG4)5-SG3-S(SEQ ID NO. 3024), encoded by SEQ ID NO. 5885; GGGGSGGGGSGGGGS (SEQ ID NO. 2962), encoded by SEQ ID NO. 5886-5891; SGGGSGGGGSGGGGSGGGGSYPYDVPDYASGGGS (SEQ ID NO. 3025), encoded by SEQ ID NO. 5892; GSGATNFSLLKQAGDVEENPGP (SEQ ID NO. 3026), encoded by SEQ ID NO. 5893; or SGGGSGGGGSGGGGSGGGSLQ (SEQ ID NO. 3027).

In one example, an artificially designed peptide linker may preferably be composed of a polymer of flexible residues like Glycine (G) and Serine (S) so that the adjacent protein domains are free to move relative to one another. Longer linkers may be used when it is desirable to ensure that two adjacent domains do not interfere with one another. The choice of a particular linker sequence may concern if it affects biological activity, stability, folding, targeting and/or pharmacokinetic features of the fusion construct. Examples of peptide linkers include, but are not limited to: SGGGSGGGGSGGGGSGGGGSGGGGSGGGGSGGGS (SEQ. ID NO. 2885; encoded by SEQ. ID NO. 5894), EGKSSGSGSESKEF (SEQ ID NO. 3028), SG3-(SG4)3-SG3-SLQ-YPYDVPDYA (SEQ ID NO. 3029), encoded by the nucleotide sequence of SEQ ID NO. 5895; DYKDDDDK (SEQ ID NO. 3030), encoded by the nucleotide sequence of SEQ ID NO. 5896; SG3-(SG4)5-SG3-S (SEQ ID NO. 3031), encoded by SEQ ID NO. 5897; SGGGSGGGGSGGGGSGGGGSYPYDVPDYASGGGS (SEQ ID NO. 3033), encoded by SEQ ID NO. 5898; GSGATNFSLLKQAGDVEENPGP (SEQ ID NO. 3034), encoded by SEQ ID NO. 5899; SGGGSGGGGSGGGGSGGGS (SEQ. ID NO. 2886; encoded by SEQ. ID NO. 5900), encoded by the nucleotide sequence of SEQ ID NO. 5901; QLIGMLQGLMRDL (SEQ ID NO. 3082), encoded by SEQ ID NO. 5902; ASFE (SEQ ID NO. 2763), encoded by SEQ ID NO. 5903; GS (encoded by GGTTCC), SG (encoded by AGCGGC), EF (encoded by GAGTTC), TS (encoded by ACTAGT), HM (encoded by CACATG), MH (encoded by ATGCAC) or GSG (encoded by GGATCCGGA or GGATCCGGT).

In one example, an artificially designed peptide linker may preferably be composed of a polymer of flexible residues like Glycine (G) and Serine (S) so that the adjacent protein domains are free to move relative to one another. Longer linkers may be used when it is desirable to ensure that two adjacent domains do not interfere with one another. The choice of a particular linker sequence may concern if it affects biological activity, stability, folding, targeting and/or pharmacokinetic features of the fusion construct. Examples of peptide linkers include, but are not limited to: MH, SG, GGSG (SEQ ID NO. 3035; encoded by the nucleotide sequence SEQ ID NO. 5904), GGSGG (SEQ ID NO. 3036; encoded by any of the nucleotide sequences SEQ ID NO. 5905-5909), GGSGGG (SEQ ID NO. 3037; encoded by any of the nucleotide sequences SEQ ID NO. 5910-5911), SGGGS (SEQ ID NO. 2977; encoded by the nucleotide sequence SEQ ID NO. 5912, 5913, 5914), GGSGGGSGG (SEQ ID NO. 3038; encoded by the nucleotide sequence SEQ ID NO. 5915), GGGGG (SEQ ID NO. 3039), GGGGS (SEQ ID NO. 3040) or (GGGGS)n (n=1 (SEQ ID NO. 3040), 2 (SEQ ID NO. 3041), 3 (SEQ ID NO. 3042, encoded by 5916, 5917, 5918, 5919, 5920, 5921), 4 (SEQ ID NO. 3044), 5 (SEQ ID NO. 3045), or 6 (SEQ ID NO. 3046)), SSSSG (SEQ ID NO. 3047) or (SSSSG)n (n=1 (SEQ ID NO. 3047), 2 (SEQ ID NO. 3048), 3 (SEQ ID NO. 3049), 4 (SEQ ID NO. 3050), 5 (SEQ ID NO. 3051), or 6 (SEQ ID NO. 3052)), SGGGSGGGGSGGGGSGGGGSGGGSLQ (SEQ ID NO. 3043; encoded by the nucleotide sequence SEQ ID NO. 5922, 5923-5928), EFSTEF (SEQ ID NO. 2761; encoded by any of the nucleotide sequences SEQ ID NO. 5929, 5930), GKSSGSGSESKS (SEQ ID NO. 3053), GGSTSGSGKSSEGKG (SEQ ID NO. 3054), GST-SGSGKSSSEGSGSTKG (SEQ ID NO. 3055), GST-SGSGKPGSGEGSTKG (SEQ ID NO. 3056), VDY-PYDVPDYALD (SEQ ID NO. 2976; encoded by nucleotide sequence SEQ ID NO. 5931), EGKSSGSGSESKEF (SEQ ID NO. 3028), SG3-(SG4)3-SG3-SLQ-YPYDVPDYA (SEQ ID NO. 3029), encoded by the nucleotide sequence of SEQ ID NO. 5932; DYKDDDDK (SEQ ID NO. 3030), encoded by the nucleotide sequence of SEQ ID NO. 5933; SG3-(SG4)5-SG3-S(SEQ ID NO. 3031), encoded by SEQ ID NO. 5934; SGGGSGGGGSGGGGSGGGGSY-PYDVPDYASGGGS (SEQ ID NO. 3032), encoded by SEQ ID NO. 5935; GSGATNFSLLKQAGDVEENPGP (SEQ ID NO. 3034), encoded by SEQ ID NO. 5936; SGGGSGGGGSGGGGSGGGGS (SEQ ID NO. 3057), encoded by the nucleotide sequence of SEQ ID NO. 5937; QLIGMLQGLMRDL (SEQ ID NO. 3082), encoded by SEQ ID NO. 5938; ASFE (SEQ ID NO. 2763), encoded by SEQ ID NO. 5939; GS (encoded by GGTTCC), SG (encoded by AGCGGC), EF (encoded by GAGTTC), TS (encoded by ACTAGT), HM (encoded by CACATG), MH (encoded by ATGCAC) or GSG (encoded by GGATCCGGA or GGATCCGGT).

In other examples, a peptide linker may be made up of a majority of amino acids that are sterically unhindered, such as Glycine (G) and Alanine (A). Exemplary linkers are polyglycines (such as (G)$_4$ (SEQ ID NO. 3058), (G)$_5$ (SEQ ID NO. 3001), (G)$_8$ (SEQ ID NO. 3059)), poly(GA), and polyalanines. The linkers described herein are exemplary, and linkers that are much longer and which include other residues are contemplated by the present invention.

A linker sequence may be a natural linker derived from a multi-domain protein. A natural linker is a short peptide sequence that separates two different domains or motifs within a protein.

In some aspects, linkers may be flexible or rigid. In other aspects, linkers may be cleavable or non-cleavable. As used herein, the terms "cleavable linker domain or region" or "cleavable peptide linker" are used interchangeably. In some embodiments, the linker sequence may be cleaved enzymatically and/or chemically. Examples of enzymes (e.g., proteinase/peptidase) useful for cleaving the peptide linker include, but are not limited to, Arg-C proteinase, Asp-N endopeptidase, chymotrypsin, clostripain, enterokinase, Factor Xa, glutamyl endopeptidase, Granzyme B, *Achromobacter* proteinase I, pepsin, proline endopeptidase, proteinase K, Staphylococcal peptidase I, thermolysin, thrombin, trypsin, and members of the Caspase family of proteolytic enzymes (e.g. Caspases 1-10). Chemical sensitive cleavage sites may also be included in a linker sequence. Examples of chemical cleavage reagents include, but are not limited to, cyanogen bromide, which cleaves methionine residues; N-chloro succinimide, iodobenzoic acid or BNPS-skatole [2-(2-nitrophenylsulfenyl)-3-methylindole], which cleaves tryptophan residues; dilute acids, which cleave at aspartyl-prolyl bonds; and e aspartic acid-proline acid cleavable recognition sites (i.e., a cleavable peptide linker comprising one or more D-P dipeptide moieties). The fusion module may include multiple regions encoding peptides of interest separated by one or more cleavable peptide linkers.

In other embodiments, a cleavable linker may be a "self-cleaving" linker peptide, such as 2A linkers (for example T2A), 2A-like linkers or functional equivalents thereof and combinations thereof. In some embodiments, the linkers include the picornaviral 2A-like linker, CHYSEL sequences of porcine teschovirus (P2A), Thosea asigna virus (T2A) or combinations, variants and functional equivalents thereof. Other linkers will be apparent to those skilled in the art and may be used in connection with alternate embodiments of the invention.

As a non-limiting example, the P2A cleavable peptide may be GATNFSLLKQAGDVEENPGP (SEQ. ID NO. 2806; encoded by SEQ. ID NO. 5940).

In other embodiments, a cleavable linker may be a "self-cleaving" linker peptide, such as 2A linker (for example T2A), 2A-like linkers or functional equivalents thereof and combinations thereof. In some embodiments, the linkers include the picornaviral 2A-like linker, CHYSEL sequences of porcine teschovirus (P2A), Thosea asigna virus (T2A) or combinations, variants and functional equivalents thereof. In some embodiments, the biocircuits of the present invention may include 2A peptides. The 2A peptide is a sequence of about 20 amino acid residues from a virus that is recognized by a protease (2A peptidases) endogenous to the cell. The 2A peptide was identified among picornaviruses, a typical example of which is the Foot- and Mouth disease virus (Robertson B H, et. al., J Virol 1985, 54:651-660). 2A-like sequences have also been found in Picornaviridae like equine rhinitis A virus, as well as unrelated viruses such as porcine teschovirus-1 and the insect Thosea asigna virus (TaV). In such viruses, multiple proteins are derived from a large polyprotein encoded by an open reading frame. The 2A peptide mediates the co-translational cleavage of this polyprotein at a single site that forms the junction between the virus capsid and replication polyprotein domains. The 2A sequences contain the consensus motif D-V/I-E-X-N-P-G-P (SEQ ID NO. 3060 (where the second amino acid is V) or SEQ ID NO. 3084 (where the second amino acid is I)). These sequences are thought to act co-translationally, preventing the formation of a normal peptide bond between the glycine and last proline, resulting in the ribosome skipping of the next codon (Donnelly M L et al. (2001). J Gen Virol, 82:1013-1025). After cleavage, the short peptide remains fused to the C-terminus of the protein upstream of the cleavage site, while the proline is added to the N-terminus of the protein downstream of the cleavage site. Of the 2A peptides identified to date, four have been widely used namely FMDV 2A (abbreviated herein as F2A); equine rhinitis A virus (ERAV) 2A (E2A); porcine teschovirus-12A (P2A) and Thoseaasigna virus 2A (T2A). In some embodiments, the 2A peptide sequences useful in the present invention are selected from SEQ ID NO. 8-11 of International Patent Publication WO2010042490, the contents of which are incorporated by reference in its entirety.

The linkers of the present invention may also be non-peptide linkers. For example, alkyl linkers such as —NH—(CH$_2$) a-C(O)—, wherein a=2-20 can be used. These alkyl linkers may further be substituted by any non-sterically hindering group such as lower alkyl (e.g., C$_1$-C$_6$) lower acyl, halogen (e.g., Cl, Br), CN, NH$_2$, phenyl, etc.

In some aspects, the linker may be an artificial linker from U.S. Pat. Nos. 4,946,778; 5,525,491; 5,856,456; and International patent publication NOs.: WO2012/083424; the contents of each of which are incorporated herein by reference in their entirety.

In some embodiments, linkers of the present invention, include without limitation, any of those taught in Table 11 of copending commonly owned U.S. Provisional Patent Application No. 62/320,864 filed on Apr. 11, 2016, or in U.S. Provisional Application No. 62/466,596 filed Mar. 3, 2017 and the International Publication WO2017/180587, the contents of each of which are incorporated herein by reference in their entirety.

In one embodiment, the linker may be a spacer region of one or more nucleotides. Non-limiting examples of spacers are TCTAGATAATACGACTCACTAGAGATCC (SEQ ID NO: 2819), TATGGCCACAACCATG (SEQ ID NO: 2820), AATCTAGATAATACGACTCACTAGAGATCC (SEQ ID NO: 2821), GCTTGCCACAACCCACAAGGA-GACGACCTTCC (SEQ ID NO: 2760), TCGCGAATG, or TCGCGA.

In one embodiment, the linker may be a BamHI site. As a non-limiting example, the BamHI site has the amino acid sequence GS and/or the DNA sequence GGATCC.

Other linkers will be apparent to those skilled in the art and may be used in connection with alternate embodiments of the invention.

The linkers of the present invention may also be non-peptide linkers. For example, alkyl linkers such as —NH—(CH$_2$) a-C(O)—, wherein a=2-20 can be used. These alkyl linkers may further be substituted by any non-sterically hindering group such as lower alkyl (e.g., C$_1$-C$_6$) lower acyl, halogen (e.g., Cl, Br), CN, NH$_2$, phenyl, etc.

In some aspects, the linker may be an artificial linker from U.S. Pat. Nos. 4,946,778, 5,525,491, 5,856,456; and International Patent Publication NO. WO2012/083424; the contents of each of which are incorporated herein by reference in their entirety.

In some embodiments, linkers of the present invention, include without limitation, any of those taught in Table 11 of copending commonly owned U.S. Provisional Patent Application No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

In some embodiments, compositions of the invention may include optional proteasome adaptors. As used herein, the term "proteasome adaptor" refers to any nucleotide/amino acid sequence that targets the appended payload for degradation. In some aspects, the adaptors target the payload for degradation directly thereby circumventing the need for ubiquitination reactions. Proteasome adaptors may be used in conjunction with destabilizing domains to reduce the basal expression of the payload. Exemplary proteasome adaptors include the UbL domain of Rad23 or hHR23b, HPV E7 which binds to both the target protein Rb and the S4 subunit of the proteasome with high affinity, which allows direct proteasome targeting, bypassing the ubiquitination machinery; the protein gankyrin which binds to Rb and the proteasome subunit S6.

6. Embedded Stimulus, Signals and Other Regulatory Features

In some embodiments, the effector module of the present invention may further comprise one or more microRNAs, microRNA binding sites, promotors and tunable elements. In one embodiment, microRNA may be used in support of the creation of tunable biocircuits. Each aspect or tuned modality may bring to the effector module or biocircuit a differentially tuned feature. For example, a destabilizing domain may alter cleavage sites or dimerization properties or half-life of the payload, and the inclusion of one or more microRNA or microRNA binding site may impart cellular detargeting or trafficking features. Consequently, the present invention embraces biocircuits which are multifactorial in their tenability. Such biocircuits and effector modules may be engineered to contain one, two, three, four or more tuned features. In some embodiments, micro RNA sequences of the present invention, include without limitation, any of those taught in Table 13 of copending commonly owned U.S. Provisional Patent Application No. 62/320,864, filed on Apr. 11, 2016, or in U.S. Provisional Application No. 62/466,596 filed Mar. 3, 2017 and the International Publication WO2017/180587, the contents of which are incorporated herein by reference in their entirety.

microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The polynucleotides of the invention may comprise one or more microRNA target sequences, microRNA sequences, or microRNA seeds. Such sequences may correspond to any known microRNA such as those taught in US Publication Nos. US2005/0261218 and US2005/0059005, the contents of each of which are incorporated herein by reference in their entirety. As a non-limiting embodiment, known microRNAs, their sequences and their binding site sequences in the human genome are in Table 14 of the commonly owned U.S. Ser. No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007

Jul. 6; 27(1):91-105. The bases of the microRNA seed have complete complementarity with the target sequence. By engineering microRNA target sequences into the polynucleotides encoding the biocircuit components, effector modules, SREs or payloads of the invention one can target the molecule for degradation or reduced translation, provided the microRNA in question is available. This process will reduce the hazard of off target effects upon nucleic acid molecule delivery.

Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136: 215-233; Landgraf et al, Cell, 2007 129:1401-1414; Gentner and Naldini, Tissue Antigens. 2012 80:393-403 and all references therein; each of which is herein incorporated by reference in its entirety).

For example, if the polynucleotide is not intended to be delivered to the liver but ends up there, then miR-122, a microRNA abundant in liver, can inhibit the expression of the polynucleotide if one or multiple target sites of miR-122 are engineered into the polynucleotide. Introduction of one or multiple binding sites for different microRNA can be engineered to further decrease the longevity, stability, and protein translation of a polynucleotide hence providing an additional layer of tenability beyond the stimulus selection, SRE design and payload variation.

As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the polynucleotides of the present invention, microRNA binding sites can be engineered out of (i.e. removed from) sequences in which they naturally occur in order to increase protein expression in specific tissues. For example, miR-122 binding sites may be removed to improve protein expression in the liver.

Regulation of expression in multiple tissues can be accomplished through introduction or removal or one or several microRNA binding sites.

Specifically, microRNAs are known to be differentially expressed in immune cells (also called hematopoietic cells), such as antigen presenting cells (APCs) (e.g. dendritic cells and macrophages), macrophages, monocytes, B lymphocytes, T lymphocytes, granulocytes, natural killer cells, etc. Immune cell specific microRNAs are involved in immunogenicity, autoimmunity, the immune-response to infection, inflammation, as well as unwanted immune response after gene therapy and tissue/organ transplantation. Immune cells specific microRNAs also regulate many aspects of development, proliferation, differentiation and apoptosis of hematopoietic cells (immune cells). For example, miR-142 and miR-146 are exclusively expressed in the immune cells, particularly abundant in myeloid dendritic cells. Introducing the miR-142 binding site into the 3'-UTR of a polypeptide of the present invention can selectively suppress the gene expression in the antigen presenting cells through miR-142 mediated mRNA degradation, limiting antigen presentation in professional APCs (e.g. dendritic cells) and thereby preventing antigen-mediated immune response after gene delivery (see, Annoni A et al., blood, 2009, 114, 5152-5161, the content of which is herein incorporated by reference in its entirety.)

In one embodiment, microRNAs binding sites that are known to be expressed in immune cells, in particular, the antigen presenting cells, can be engineered into the polynucleotides to suppress the expression of the polynucleotide in APCs through microRNA mediated RNA degradation, subduing the antigen-mediated immune response, while the expression of the polynucleotide is maintained in non-immune cells where the immune cell specific microRNAs are not expressed.

Many microRNA expression studies have been conducted, and are described in the art, to profile the differential expression of microRNAs in various cancer cells/tissues and other diseases. Some microRNAs are abnormally over-expressed in certain cancer cells and others are under-expressed. For example, microRNAs are differentially expressed in cancer cells (WO2008/154098, US2013/ 0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264); hepatocellular carcinoma (WO2012/151212, US2012/ 0329672, WO2008/054828, U.S. Pat. No. 8,252,538); lung cancer cells (WO2011/076143, WO2013/033640, WO2009/ 070653, US2010/0323357); cutaneous T cell lymphoma (WO2013/011378); colorectal cancer cells (WO2011/ 0281756, WO2011/076142); cancer positive lymph nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/ 0316081, US2012/0283310, WO2010/018563, the content of each of which is incorporated herein by reference in their entirety).

In some embodiments, micro RNA sequences of the present invention, include without limitation, any of those taught in Table 13 of copending commonly owned U.S. Provisional Patent Application No. 62/320,864 filed on Apr. 11, 2016, or in U.S. Provisional Application No. 62/466,596 filed Mar. 3, 2017 and the International Publication WO2017/180587, the contents of each of which are incorporated herein by reference in their entirety.

In some embodiments, compositions of the invention may include optional proteasome adaptors. As used herein, the term "proteasome adaptor" refers to any nucleotide/amino acid sequence that targets the appended payload for degradation. In some aspects, the adaptors target the payload for degradation directly thereby circumventing the need for ubiquitination reactions. Proteasome adaptors may be used in conjunction with destabilizing domains to reduce the basal expression of the payload. Exemplary proteasome adaptors include the UbL domain of Rad23 or hHR23b, HPV E7 which binds to both the target protein Rb and the S4 subunit of the proteasome with high affinity, which allows direct proteasome targeting, bypassing the ubiquitination machinery; the protein gankyrin which binds to Rb and the proteasome subunit S6.

In one embodiment, microRNA may be used as described herein in support of the creation of tunable biocircuits.

In some embodiments, effector modules may be designed to encode (as a DNA or RNA or mRNA) one or more payloads, SREs and/or regulatory sequence such as a microRNA or microRNA binding site. In some embodiments, any of the encoded payloads or SREs may be stabilized or de-stabilized by mutation and then combined with one or more regulatory sequences to generate a dual or multi-tuned effector module or biocircuit system.

Each aspect or tuned modality may bring to the effector module or biocircuit a differentially tuned feature. For example, an SRE may represent a destabilizing domain, while mutations in the protein payload may alter its cleavage sites or dimerization properties or half-life and the inclusion of one or more microRNA or microRNA binding site may impart cellular detargeting or trafficking features. Consequently, the present invention embraces biocircuits which are multifactorial in their tenability.

In some embodiments, compositions of the invention may include optional proteasome adaptors. As used herein, the term "proteasome adaptor" refers to any nucleotide/amino acid sequence that targets the appended payload for degradation. In some aspects, the adaptors target the payload for degradation directly thereby circumventing the need for ubiquitination reactions. Proteasome adaptors may be used in conjunction with destabilizing domains to reduce the basal expression of the payload. Exemplary proteasome adaptors include the UbL domain of Rad23 or hHR23b, HPV E7 which binds to both the target protein Rb and the S4 subunit of the proteasome with high affinity, which allows direct proteasome targeting, bypassing the ubiquitination machinery; the protein gankyrin which binds to Rb and the proteasome subunit S6.

Such biocircuits may be engineered to contain one, two, three, four or more tuned features.

In some embodiments, microRNA sequences of the present invention, include without limitation, any of those taught in Table 13 of copending commonly owned U.S. Provisional Patent Application No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

Polynucleotides

The present invention provides polynucleotides encoding novel hDHFR DDs, effector modules comprising payloads and associated DDs, biocircuit systems comprising DDs and effector modules, and other components of the present invention.

The term "polynucleotide" or "nucleic acid molecule" in its broadest sense, includes any compound and/or substance that comprise a polymer of nucleotides, e.g., linked nucleosides. These polymers are often referred to as polynucleotides. Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

In some embodiments, polynucleotides of the invention may be a messenger RNA (mRNA) or any nucleic acid molecule and may or may not be chemically modified. In one aspect, the nucleic acid molecule is a mRNA. As used herein, the term "messenger RNA (mRNA)" refers to any polynucleotide which encodes a polypeptide of interest and which is capable of being translated to produce the encoded polypeptide of interest in vitro, in vivo, in situ or ex vivo.

Traditionally, the basic components of an mRNA molecule include at least a coding region, a 5'UTR, a 3'UTTR, a 5' cap and a poly-A tail. Building on this wild type modular structure, the present invention expands the scope of functionality of traditional mRNA molecules by providing payload constructs which maintain a modular organization, but which comprise one or more structural and/or chemical modifications or alterations which impart useful properties to the polynucleotide, for example tenability of function. As used herein, a "structural" feature or modification is one in which two or more linked nucleosides are inserted, deleted, duplicated, inverted or randomized in a polynucleotide without significant chemical modification to the nucleosides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCG". Here, the dinucleotide "CC" has been inserted, resulting in a structural modification to the polynucleotide.

In some embodiments, polynucleotides of the present invention may harbor 5'UTR sequences which play a role in translation initiation. 5'UTR sequences may include features such as Kozak sequences which are commonly known to be involved in the process by which the ribosome initiates translation of genes, Kozak sequences have the consensus XCCR(A/G)CC-start codon (AUG), where R is a purine (adenine or guanine) three bases upstream of the start codon (AUG) and X is any nucleotide. In one embodiment, the Kozak sequence is ACCGCC. By engineering the features that are typically found in abundantly expressed genes of target cells or tissues, the stability and protein production of the polynucleotides of the invention can be enhanced.

In some embodiments, polynucleotides of the present invention may harbor 5'UTR sequences which play a role in translation initiation. 5'UTR sequences may include features such as Kozak sequences which are commonly known to be involved in the process by which the ribosome initiates translation of genes, Kozak sequences have the consensus XCCR(A/G) CCAUG, where R is a purine (adenine or guanine) three bases upstream of the start codon (AUG) and X is any nucleotide. In one embodiment, the Kozak sequence is ACCGCC.

In some embodiments, polynucleotides of the present invention may harbor 5'UTR sequences which play a role in translation initiation. 5'UTR sequences may include features such as Kozak sequences which are commonly known to be involved in the process by which the ribosome initiates translation of genes, Kozak sequences have the consensus XCCR(A/G) CCAUG, where R is a purine (adenine or guanine) three bases upstream of the start codon (AUG) and X is any nucleotide. In one embodiment, the Kozak sequence is ACCGCC. By engineering the features that are typically found in abundantly expressed genes of target cells or tissues, the stability and protein production of the polynucleotides of the invention can be enhanced.

Further provided are polynucleotides, which may contain an internal ribosome entry site (IRES) which play an important role in initiating protein synthesis in the absence of 5' cap structure in the polynucleotide. An IRES may act as the sole ribosome binding site, or may serve as one of the multiple binding sites. Polynucleotides of the invention containing more than one functional ribosome binding site may encode several peptides or polypeptides that are translated independently by the ribosomes giving rise to bicistronic and/or multicistronic nucleic acid molecules.

In some embodiments, polynucleotides encoding biocircuits, effector modules, SREs and payloads of interest such as immunotherapeutic agents may include from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000 nucleotides). In some aspects, polynucleotides of the invention may include more than 10,000 nucleotides.

Regions of the polynucleotides which encode certain features such as cleavage sites, linkers, trafficking signals, tags or other features may range independently from 10-1,000 nucleotides in length (e.g., greater than 20, 30, 40, 45, 50, 55, 60, 70, 80, 90, 100, 120, 140, 160, 180, 200, 250, 300, 350, 400, 450, 500, 600, 700, 800, and 900 nucleotides or at least 10, 15, 20, 25, 30, 35, 40, 45, 50, 55, 60, 70, 80, 90, 100, 120, 140, 160, 180, 200, 250, 300, 350, 400, 450, 500, 600, 700, 800, 900, and 1,000 nucleotides).

In some embodiments, polynucleotides of the present invention may further comprise embedded regulatory moieties such as microRNA binding sites within the 3'UTR of nucleic acid molecules which when bind to microRNA molecules, down-regulate gene expression either by reducing nucleic acid molecule stability or by inhibiting translation. Conversely, for the purposes of the polynucleotides of the present invention, microRNA binding sites can be engineered out of (i.e. removed from) sequences in which they naturally occur in order to increase protein expression in specific tissues. For example, miR-142 and miR-146 binding sites may be removed to improve protein expression in the immune cells. In some embodiments, any of the encoded payloads may be may be regulated by an SRE and then combined with one or more regulatory sequences to generate a dual or multi-tuned effector module or biocircuit system.

In some embodiments, polynucleotides of the present invention may encode fragments, variants, derivatives of polypeptides of the inventions. In some aspects, the variant sequence may keep the same or a similar activity. Alternatively, the variant may have an altered activity (e.g., increased or decreased) relative to the start sequence. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen et al., Gapped BLAST and PSI-BLAST: a new generation of protein database search programs, *Nucleic Acids Res.*, 1997, 25:3389-3402.)

In some embodiments, polynucleotides of the present invention may be modified. As used herein, the terms "modified", or as appropriate, "modification" refers to chemical modification with respect to A, G, U (T in DNA) or C nucleotides. Modifications may be on the nucleoside base and/or sugar portion of the nucleosides which comprise the polynucleotide. In some embodiments, multiple modifications are included in the modified nucleic acid or in one or more individual nucleoside or nucleotide. For example, modifications to a nucleoside may include one or more modifications to the nucleobase and the sugar. Modifications to the polynucleotides of the present invention may include any of those taught in, for example, International Publication NO. WO2013/052523, the contents of which are incorporated herein by reference in its entirety.

As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group.

In some embodiments, the modification may be on the internucleoside linkage (e.g., phosphate backbone). Herein, in the context of the polynucleotide backbone, the phrases "phosphate" and "phosphodiester" are used interchangeably. Backbone phosphate groups can be modified by replacing one or more of the oxygen atoms with a different substituent. Further, the modified nucleosides and nucleotides can include the wholesale replacement of an unmodified phosphate moiety with another internucleoside linkage. Examples of modified phosphate groups include, but are not limited to, phosphorothioate, phosphoroselenates, boranophosphates, boranophosphate esters, hydrogen phosphonates, phosphoramidates, phosphorodiamidates, alkyl or aryl phosphonates, and phosphotriesters. Phosphorodithioates have both non-linking oxygens replaced by sulfur. The phosphate linker can also be modified by the replacement of a linking oxygen with nitrogen (bridged phosphoramidates), sulfur (bridged phosphorothioates), and carbon (bridged methylene-phosphonates). Other modifications which may be used are taught in, for example, International Application NO. WO2013/052523, the contents of which are incorporated herein by reference in their entirety.

Chemical modifications and/or substitution of the nucleotides or nucleobases of the polynucleotides of the invention which are useful in the present invention include any modified substitutes known in the art, for example, (±)1-(2-Hydroxypropyl)pseudouridine TP, (2R)-1-(2-Hydroxypropyl)pseudouridine TP, 1-(4-Methoxy-phenyl)pseudo-UTP, 2'-O-dimethyladenosine, 1,2'-O-dimethylguanosine, 1,2'-O-dimethylinosine, 1-Hexyl-pseudo-UTP, 1-Homoallylpseudouridine TP, 1-Hydroxymethylpseudouridine TP, 1-isopropyl-pseudo-UTP, 1-Me-2-thio-pseudo-UTP, 1-Me-4-thio-pseudo-UTP, 1-Me-alpha-thio-pseudo-UTP, 1-Me-GTP, 2'-Amino-2'-deoxy-ATP, 2'-Amino-2'-deoxy-CTP, 2'-Amino-2'-deoxy-GTP, 2'-Amino-2'-deoxy-UTP, 2'-Azido-2'-deoxy-ATP, tubercidine, undermodified hydroxywybutosine, uridine 5-oxyacetic acid, uridine 5-oxyacetic acid methyl ester, wybutosine, wyosine, xanthine, Xanthosine-5'-TP, xylo-adenosine, zebularine, α-thio-adenosine, α-thio-cytidine, α-thio-guanosine, and/or α-thio-uridine.

Polynucleotides of the present invention may comprise one or more of the modifications taught herein. Different sugar modifications, base modifications, nucleotide modifications, and/or internucleoside linkages (e.g., backbone structures) may exist at various positions in the polynucleotide of the invention. One of ordinary skill in the art will appreciate that the nucleotide analogs or other modification(s) may be located at any position(s) of a polynucleotide such that the function of the polynucleotide is not substantially decreased. A modification may also be a 5' or 3' terminal modification. The polynucleotide may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%).

In some embodiments, one or more codons of the polynucleotides of the present invention may be replaced with other codons encoding the native amino acid sequence to tune the expression of the SREs, through a process referred to as codon selection. Since mRNA codon, and tRNA anticodon pools tend to vary spatiotemporally i.e. among organisms, cell types, sub cellular locations and over time, the codon selection described herein is a spatiotemporal (ST) codon selection.

In some embodiments of the invention, certain polynucleotide features may be codon optimized. Codon optimization refers to a process of modifying a nucleic acid sequence for enhanced expression in the host cell by replacing at least 1, 2, 3, 4, 5, 10, 15, 20, 25, 50 or more codons of the native sequence with codons that are most frequently used in the genes of that host cell while maintaining the native amino acid sequence. Codon usage may be measured using the Codon Adaptation Index (CAI) which measures the deviation of a coding polynucleotide sequence from a reference gene set. Codon usage tables are available at the Codon Usage Database (www.kazusa.or.jp/codon/) and the CAI can be calculated by EMBOSS CAI program (emboss.sourceforge.net/). Codon optimization methods are known in the art and may be useful in efforts to achieve one or more of several goals. These goals include to match codon frequencies in target and host organisms to ensure proper folding, bias nucleotide content to alter stability or reduce secondary structures, minimize tandem repeat codons or base runs that may impair gene construction or expression, customize transcriptional and translational control regions, insert or remove protein signaling sequences, remove/add post translation modification sites in encoded protein (e.g. glycosylation sites), add, remove or shuffle protein domains, insert or delete restriction sites, modify ribosome binding sites and degradation sites, to adjust translational rates to allow the various domains of the protein to fold properly, or to reduce or eliminate problem secondary structures within the polynucleotide. Codon optimization tools, algorithms and services are known in the art, and non-limiting examples include services from GeneArt (Life Technologies), DNA2.0 (Menlo Park Calif.), OptimumGene (GenScript, Piscataway, N.J.), algorithms such as but not limited to, DNAWorks v3.2.3, Mr. Gene (GmBH, Regensburg, Germany) and/or proprietary methods. In one embodiment, a polynucleotide sequence or portion thereof is codon optimized using optimization algorithms. Codon options for each amino acid are well-known in the art as are various species table for optimizing for expression in that particular species.

In some embodiments of the invention, certain polynucleotide features may be codon optimized. For example, a preferred region for codon optimization may be upstream (5') or downstream (3') to a region which encodes a polypeptide. These regions may be incorporated into the polynucleotide before and/or after codon optimization of the payload encoding region or open reading frame (ORF).

After optimization (if desired), the polynucleotide components are reconstituted and transformed into a vector such as, but not limited to, plasmids, viruses, cosmids, and artificial chromosomes.

Spatiotemporal codon selection may impact the expression of the polynucleotides of the invention, since codon composition determines the rate of translation of the mRNA species and its stability. For example, tRNA anticodons to optimized codons are abundant, and thus translation may be enhanced. In contrast, tRNA anticodons to less common codons are fewer and thus translation may proceed at a slower rate. Presnyak et al. have shown that the stability of an mRNA species is dependent on the codon content, and higher stability and thus higher protein expression may be achieved by utilizing optimized codons (Presnyak et al. (2015) Cell 160, 1111-1124; the contents of which are incorporated herein by reference in their entirety). Thus, in some embodiments, ST codon selection may include the selection of optimized codons to enhance the expression of the SRES, effector modules and biocircuits of the invention. In other embodiments, spatiotemporal codon selection may involve the selection of codons that are less commonly used in the genes of the host cell to decrease the expression of the compositions of the invention. The ratio of optimized codons to codons less commonly used in the genes of the host cell may also be varied to tune expression.

In some embodiments, certain regions of the polynucleotide may be preferred for codon selection. For example, a preferred region for codon selection may be upstream (5') or downstream (3') to a region which encodes a polypeptide. These regions may be incorporated into the polynucleotide before and/or after codon selection of the payload encoding region or open reading frame (ORF).

The stop codon of the polynucleotides of the present invention may be modified to include sequences and motifs to alter the expression levels of the SREs, payloads and effector modules of the present invention. Such sequences may be incorporated to induce stop codon readthrough, wherein the stop codon may specify amino acids e.g. selenocysteine or pyrrolysine. In other instances, stop codons may be skipped altogether to resume translation through an alternate open reading frame. Stop codon read through may be utilized to tune the expression of components of the effector modules at a specific ratio (e.g. as dictated by the stop codon context). Examples of preferred stop codon motifs include UGAN, UAAN, and UAGN, where N is either C or U.

Polynucleotide modifications and manipulations can be accomplished by methods known in the art such as, but not limited to, site directed mutagenesis and recombinant technology. The resulting modified molecules may then be tested for activity using in vitro or in vivo assays such as those described herein or any other suitable screening assay known in the art.

In some embodiments, polynucleotides of the invention may comprise two or more effector module sequences, or two or more payload of interest sequences, which are in a pattern such as ABABAB or AABBAABBAABB or ABCABCABC or variants thereof repeated once, twice, or more than three times. In these patterns, each letter, A, B, or C represent a different effector module component.

In yet another embodiment, polynucleotides of the invention may comprise two or more effector module component sequences with each component having one or more SRE sequences (DD sequences), or two or more payload sequences. As a non-limiting example, the sequences may be in a pattern such as ABABAB or AABBAABBAABB or ABCABCABC or variants thereof repeated once, twice, or more than three times in each of the regions. As another non-limiting example, the sequences may be in a pattern such as ABABAB or AABBAABBAABB or ABCABCABC or variants thereof repeated once, twice, or more than three times across the entire polynucleotide. In these patterns, each letter, A, B, or C represent a different sequence or component.

According to the present invention, polynucleotides encoding distinct biocircuits, effector modules, SREs and payload constructs may be linked together through the 3'-end using nucleotides which are modified at the 3'-terminus. Chemical conjugation may be used to control the stoichiometry of delivery into cells. Polynucleotides can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug. As non-limiting examples, they may be conjugates with other immune conjugates.

In some embodiments, the compositions of the polynucleotides of the invention may be generated by combining the various components of the effector modules using the Gibson assembly method. The Gibson assembly reaction consists of three isothermal reactions, each relying on a different enzymatic activity including a 5' exonuclease which generates long overhangs, a polymerase which fills in the gaps of the annealed single strand regions and a DNA ligase which seals the nicks of the annealed and filled-in gaps. Polymerase chain reactions performed prior to Gibson assembly which may be used to generate PCR products with overlapping sequence. These methods can be repeated sequentially, to assemble larger and larger molecules. For example, the method can comprise repeating a method as above to join a second set of two or more DNA molecules of interest to one another, and then repeating the method again to join the first and second set DNA molecules of interest, and so on. At any stage during these multiple rounds of assembly, the assembled DNA can be amplified by transforming it into a suitable microorganism, or it can be amplified in vitro (e.g., with PCR).

In some embodiments, polynucleotides of the invention may encode a fusion polypeptide comprising a destabilizing domain (DD) and at least one immunotherapeutic agent taught herein. The DD domain may be a hDHFR mutant derived by site directed mutagenesis and may be selected from the single mutation hDHFR (Y122I) (e.g., the nucleic acid sequence of SEQ ID NO. 5941 (starting from amino acid 2-187 of the wild type hDHFR sequence) or the codon optimized nucleic acid sequence of SEQ ID NO. 5942), double mutations hDHFR (M53T, R138I) (e.g., the nucleic acid sequence of SEQ ID NO. 5943), hDHFR (V75F, Y122I) (e.g., the nucleic acid sequence of SEQ ID NO. 5944), hDHFR (A125F, Y122I) (e.g., the nucleic acid sequence of SEQ ID NO. 5945 (starting from amino acid 2-187 of the wild type hDHFR sequence) or the codon optimized nucleic acid sequence of SEQ ID NO. 5946), hDHFR (L74N, Y122I) (e.g., the nucleic acid sequence of SEQ ID NO. 5947), hDHFR (L94A, T147A) (e.g., the nucleic acid sequence of SEQ ID NO. 5948), hDHFR (G21T, Y122I) (e.g., the nucleic acid sequence of SEQ ID NO. 5949), hDHFR (V121A, Y122I) (e.g., the nucleic acid sequence of SEQ ID NO. 5950, and hDHFR (Q36K, Y122I) comprising the nucleic acid sequence of SEQ ID NO. 5951 (starting from amino acid 2-187 of the wild type hDHFR sequence) or the codon optimized nucleic acid sequence of SEQ NO. 5952), and triple mutations hDHFR (Q36F, N65F, Y122I) (e.g., the nucleic acid sequence of SEQ ID NO. 5953 (starting from amino acid 2-187 of the wild type hDHFR sequence) or the codon optimized nucleic acid sequence of SEQ ID NO. 5954), hDHFR (Q36F, Y122I, A125F) (e.g., the nucleic acid sequence of SEQ ID NO. 5955 (starting from amino acid 2-187 of the wild type hDHFR sequence)). In other embodiments, the DHFR mutant may be derived by random mutagenesis and may include hDHFR mutant comprising the nucleic acid sequence of SEQ ID NO. 90-117, 119-125 and 2738.

In some embodiments, the polynucleotides of the invention may encode effector modules comprising the hDHFR DD-CD19CAR fusion polypeptide comprising the nucleotide sequence of SEQ ID NO. 5956-5959, 5960, 5961, or 5962, 5963 or hDHFR DD-IL15/IL15Ra fusion polypeptide comprising the nucleotide sequence of SEQ ID NO. 5964-5966, or hDHFR DD-IL12 fusion polypeptide comprising the nucleotide sequence of SEQ ID NO. 5967-5968; or a hDHFR DD-Caspase 9 fusion polypeptide comprising the nucleotide sequence of SEQ ID NO. 5969-5971.

In some embodiments, polynucleotides of the present invention may encode a fusion polypeptide comprising a destabilizing domain (DD) and at least one immunotherapeutic agent taught herein. The DD domain may be a FKBP mutant encoded by nucleotide sequence of SEQ ID NO: 5972-5983, and/or 5984, an ecDHFR mutant encoded by nucleotide sequence of SEQ ID NO: 5985-5992, and/or 5993, hDHFR mutant encoded by nucleotide sequence of SEQ ID NO: 5994-6008 and/or 6048-6050, 6096, 6047, 6045, 6046, 6052, 6053, 6009-6044, 6055, and/or 6056-6059.

In some embodiments, the polynucleotides of the invention may encode effector modules comprising the CD19 CAR as the payload comprising the nucleotide sequence of SEQ ID NO: 6060-6074 and/or 1662-1646, 3080, 1713-1717, 1719-1723, 2761, or IL12 as the payload comprising the nucleotide sequence of SEQ ID NO. 6075-6083, or IL15 as the payload comprising the nucleotide sequence of SEQ ID NO: 6084-6086, and/or 6087, 6088, or IL15/IL15Ra fusion polypeptide as the payload comprising the nucleotide sequence of SEQ ID NO: 6089-6115, 6116, and/or 6117.

In some embodiments, polynucleotides of the present invention may encode a fusion polypeptide comprising a destabilizing domain (DD) and at least one immunotherapeutic agent taught herein. The DD domain may be a FKBP mutant encoded by nucleotide sequence of SEQ. ID NO. 6118-6120, and/or 6121-6124, an ecDHFR mutant encoded by nucleotide sequence of SEQ. ID NO. 6125-6128 and/or 6129, hDHFR mutant encoded by nucleotide sequence of SEQ. ID NO. 6130-6144, 6151-6155, and/or 5551, 5552, 5554, 5555, 5556, 5557, 5558, 6151.

In some embodiments, the polynucleotides of the invention may encode effector modules comprising IL15 as the payload comprising the nucleotide sequence of SEQ ID NOs. 6156-6160, or IL15/IL15Ra fusion polypeptide as the payload comprising the nucleotide sequence of SEQ ID NOs. 6161-6186, and/or 6187.

In some embodiments, polynucleotides of the present invention may encode a fusion polypeptide comprising a destabilizing domain (DD) and at least one immunotherapeutic agent taught herein. The DD domain may be a FKBP mutant encoded by nucleotide sequence of SEQ ID NO. 6188-6193, hDHFR mutant encoded by nucleotide sequence of SEQ ID NO. 6194-6204, 3105, and/or 2586-6240.

In some embodiments, the polynucleotides of the invention may encode effector modules comprising IL12 as the payload encoded by the nucleotide sequence SEQ ID NO. 6241-6249, or IL15 as the payload comprising the nucleotide sequence of SEQ ID NO. 6250, 6251, or 6252-6254.

In some embodiments, polynucleotides of the present invention may encode a fusion polypeptide comprising a destabilizing domain (DD) and at least one immunotherapeutic agent taught herein. The DD domain may be a FKBP mutant encoded by nucleotide sequence of SEQ ID NOS. 6255-6257, and/or 6258-6269, an ecDHFR mutant encoded by nucleotide sequence of SEQ ID NO. 6270-6272, and/or 6273-6281, hDHFR mutant encoded by nucleotide sequence of SEQ ID NO. 6282-6295, SEQ ID NO. 6296-6331, and/or 6332-6344, 6345-6347.

In some embodiments, the polynucleotides of the invention may encode effector modules comprising IL2 as the payload comprising the nucleotide sequence of SEQ ID NO. 6348-6350, or caspase 9 as the payload comprising the nucleotide sequence of SEQ ID NO. 6351-6359, or FOXP3 as the payload, comprising the nucleotide sequence of SEQ ID NO. 6360-6369 or luciferase as the payload comprising the nucleotide sequence of SEQ ID NO. 2699-2703 and 3061, or BCMA CAR as the payload comprising the nucleotide sequence of SEQ ID NO. 6370-6372 or Her2 as the payload comprising the nucleotide sequence of 907.

Cells

In accordance with the present invention, cells genetically modified to express at least one biocircuit, SRE (e.g. DD), effector module and immunotherapeutic agent of the invention, are provided. Cells of the invention may include, without limitation, immune cells, stem cells and tumor cells. In some embodiments, immune cells are immune effector cells, including, but not limiting to, T cells such as CD8+ T cells and CD4+ T cells (e.g., Th1, Th2, Th17, Foxp3+ cells), memory T cells such as T memory stem cells, central T memory cells, and effector memory T cells, terminally differentiated effector T cells, natural killer (NK) cells, NK T cells, tumor infiltrating lymphocytes (TILs), cytotoxic T lymphocytes (CTLs), regulatory T cells (Tregs), and dendritic cells (DCs), other immune cells that can elicit an effector function, or the mixture thereof. T cells may be Tαβ cells and Tγδ cells. In some embodiments, stem cells may be from human embryonic stem cells, mesenchymal stem cells, and neural stem cells. In some embodiments, T cells may be depleted endogenous T cell receptors (See U.S. Pat. Nos. 9,273,283; 9,181,527; and 9,028,812; the contents of each of which are incorporated herein by reference in their entirety).

In some embodiments, cells of the invention may be autologous, allogeneic, syngeneic, or xenogeneic in relation to a particular individual subject.

In some embodiments, cells of the invention may be mammalian cells, particularly human cells. Cells of the invention may be primary cells or immortalized cell lines.

In some embodiments, cells of the invention may include expansion factors as payload to trigger proliferation and expansion of the cells. Exemplary payloads include RAS such as KRAS, NRAS, RRAS, RRAS2, MRAS, ERAS, and HRAS, DIRAS such as DIRAS1, DIRAS2, and DIRAS3, NKIRAS such as NKIRAS1, and NKIRAS2, RAL such as RALA, and RALB, RAP such as RAP1A, RAP1B, RAP2A, RAP2B, and RAP2C, RASD such as RASD1, and RASD2, RASL such as RASL10A, RASL10B, RASL11A, RASL11B, and RASL12, REM such as REM1, and REM2, GEM, RERG, RERGL, and RRAD.

In some embodiments, cells of the invention may be expanded using expansion factors to trigger proliferation and expansion of the cells. Exemplary expansion factors include RAS such as KRAS, NRAS, RRAS, RRAS2, MRAS, ERAS, and HRAS, DIRAS such as DIRAS1, DIRAS2, and DIRAS3, NKIRAS such as NKIRAS 1, and NKIRAS2, RAL such as RALA, and RALB, RAP such as RAP1A, RAP1B, RAP2A, RAP2B, and RAP2C, RASD such as RASD1, and RASD2, RASL such as RASL10A, RASL10B, RASL11A, RASL11B, and RASL12, REM such as REM1, and REM2, GEM, RERG, RERGL, and RRAD.

Engineered immune cells can be accomplished by transducing a cell compositions with a polypeptide of a biocircuit, an effector module, a SRE and/or a payload of interest (i.e., immunotherapeutic agent), or a polynucleotide encoding said polypeptide, or a vector comprising said polynucleotide. The vector may be a viral vector such as a lentiviral vector, a gamma-retroviral vector, a recombinant AAV, an adenoviral vector and an oncolytic viral vector. In other aspects, non-viral vectors for example, nanoparticles and liposomes may also be used. In some embodiments, immune cells of the invention are genetically modified to express at least one immunotherapeutic agent of the invention which is tunable using a stimulus. In some examples, two, three or more immunotherapeutic agents constructed in the same biocircuit and effector module are introduced into a cell. In other examples, two, three, or more biocircuits, effector modules, each of which comprises an immunotherapeutic agent, may be introduced into a cell.

In some embodiments, T cells expressing Chimeric antigen receptors (CARs) or T cells receptors (TCRs) may be further modified to express another one, two, three or more immunotherapeutic agents of the present invention. The immunotherapeutic agents may be another a cytokine such as IL2, IL12, IL15 and IL18; a regulatory switch; or a safety switch gene (e.g., a suicide gene) that kills activated T cells when a severe event is observed after adoptive cell transfer or when the transferred immune cells are no-longer needed. These molecules may be included in the same effector module or in separate effector modules.

In some embodiments, immune cells of the invention may be T cells modified to express an antigen-specific T cell receptor (TCR), or an antigen specific chimeric antigen receptor (CAR) taught herein (known as CAR T cells). Accordingly, at least one polynucleotide encoding a CAR system (or a TCR) described herein, or a vector comprising the polynucleotide is introduced into a T cell. The T cell expressing the CAR or TCR binds to a specific antigen via the extracellular targeting moiety of the CAR or TCR, thereby a signal via the intracellular signaling domain (s) is transmitted into the T cell, and as a result, the T cell is activated. The activated CAR T cell changes its behavior including release of a cytotoxic cytokine (e.g., a tumor necrosis factor, and lymphotoxin, etc.), improvement of a cell proliferation rate, change in a cell surface molecule, or the like. Such changes cause destruction of a target cell expressing the antigen recognized by the CAR or TCR. In addition, release of a cytokine or change in a cell surface molecule stimulates other immune cells, for example, a B cell, a dendritic cell, a NK cell, and a macrophage.

The CAR introduced into a T cell may be a first-generation CAR including only the intracellular signaling domain from TCR CD3zeta, or a second-generation CAR including the intracellular signaling domain from TCR CD3zeta and a costimulatory signaling domain, or a third-generation CAR including the intracellular signaling domain from TCR CD3zeta and two or more costimulatory signaling domains, or a split CAR system, or an on/off switch CAR system. In one example, the expression of the CAR or TCR is controlled by a destabilizing domain (DD) such as a hDHFR mutant, in the effector module of the invention. The presence or absence of hDHFR binding ligand such as TMP is used to tune the CAR or TCR expression in transduced T cells or NK cells.

In some embodiments, CAR T cells of the invention may be further modified to express another one, two, three or more immunotherapeutic agents. The immunotherapeutic agents may be another CAR or TCR specific to a different target molecule; a cytokine such as IL2, IL12, IL15 and IL18, or a cytokine receptor such as IL15Rα; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed. These molecules may be included in the same effector module or in separate effector modules.

In one embodiment, the Chimeric antigen receptor expressing T cell (including TCR T cell) may be an "armed" CAR T cell which is transformed with a CAR and an effector module comprising a cytokine. The inducible or constitutively secrete active cytokines further armor CAR T cells to improve efficacy and persistence. In this context, such CAR T cell is also referred to as "armored CAR T cell". The "armor" molecule may be selected based on the tumor microenvironment and other elements of the innate and adaptive immune systems. In some embodiments, the molecule may be a stimulatory factor such as IL2, IL12, IL15, IL18, type I IFN, CD40L and 4-1BBL which have been shown to further enhance CAR T cell efficacy and persistence in the face of a hostile tumor microenvironment via different mechanisms (Yeku et al., *Biochem Soc Trans.*, 2016, 44(2): 412-418). In one embodiment, the cytokine may be IL12. Such T cells, after CAR mediated activation in the tumor, release inducible IL12 which augments T-cell activation and attracts and activates innate immune cells to eliminate CD19-negative cancer cells.

In one embodiment, the CAR T cell (including TCR T cell) of the invention may be an "armed" CAR T cell which is transformed with an effector module comprising a CAR and an effector module comprising a cytokine. The inducible or constitutively secrete active cytokines further armor CAR T cells to improve efficacy and persistence. In this context, such CAR T cell is also referred to as "armored CAR T cell". The "armor" molecule may be selected based on the tumor microenvironment and other elements of the innate and adaptive immune systems. In some embodiments, the molecule may be a stimulatory factor such as IL2, IL12, IL15, IL18, type I IFN, CD40L and 4-1BBL which have been shown to further enhance CAR T cell efficacy and persistence in the face of a hostile tumor microenvironment via different mechanisms (Yeku et al., *Biochem Soc Trans.*, 2016, 44(2): 412-418).

In some aspects, the armed CAR T cell of the invention is modified to express a CD19 CAR and IL12. Such T cells, after CAR mediated activation in the tumor, release inducible IL12 which augments T-cell activation and attracts and activates innate immune cells to eliminate CD19-negative cancer cells.

In one embodiment, T cells of the invention may be modified to express an effector module comprising a CAR and an effector module comprising a suicide gene.

In one embodiment, the CAR T cell (including TCR T cell) of the invention may be transformed with effector modules comprising a cytokine and a safety switch gene (e.g., suicide gene). The suicide gene may be an inducible caspase such as caspase 9 which induces apoptosis, when activated by an extracellular stimulus of a biocircuit system. Such induced apoptosis eliminates transferred cell as required to decrease the risk of direct toxicity and uncontrolled cell proliferation.

In some embodiments, immune cells of the invention may be NK cells modified to express an antigen-specific T cell receptor (TCR), or an antigen specific chimeric antigen receptor (CAR) taught herein.

In some embodiments, immune cells of the invention may be NK cells modified to payloads and effector modules taught herein.

In some embodiments, immune cells of the invention may be NK cells modified to express payloads of the invention.

Natural killer (NK) cells are members of the innate lymphoid cell family and characterized in humans by expression of the phenotypic marker CD56 (neural cell adhesion molecule) in the absence of CD3 (T-cell co-receptor). NK cells are potent effector cells of the innate immune system which mediate cytotoxic attack without the requirement of prior antigen priming, forming the first line of defense against diseases including cancer malignancies and viral infection.

Several pre-clinical and clinical trials have demonstrated that adoptive transfer of NK cells is a promising treatment approach against cancers such as acute myeloid leukemia (Ruggeri et al., *Science;* 2002, 295: 2097-2100; and Geller et al., *Immunotherapy,* 2011, 3: 1445-1459). Adoptive transfer of NK cells expressing CAR such as DAP12-Based Activating CAR revealed improved eradication of tumor cells (Topfer et al., *J Immunol.* 2015; 194:3201-3212). NK cell engineered to express a CS-1 specific CAR also displayed enhanced cytolysis and interferon-γ (IFN-γ) production in multiple myeloma (Chu et al., *Leukemia,* 2014, 28(4): 917-927).

NK cell activation is characterized by an array of receptors with activating and inhibitory functions. The important activation receptors on NK cells include CD94/NKG2C and NKG2D (the C-type lectin-like receptors), and the natural cytotoxicity receptors (NCR) NKp30, NKp44 and NKp46, which recognize ligands on tumor cells or virally infected cells. NK cell inhibition is essentially mediated by interactions of the polymorphic inhibitory killer cell immunoglobulin-like receptors (KIRs) with their cognate human-leukocyte-antigen (HLA) ligands via the alpha-1 helix of the HLA molecule. The balance between signals that are generated from activating receptors and inhibitory receptors mainly determines the immediate cytotoxic activation.

NK cells may be isolated from peripheral blood mononuclear cells (PBMCs), or derived from human embryonic stem (ES) cells and induced pluripotent stem cells (iPSCs). The primary NK cells isolated from PBMCs may be further expanded for adoptive immunotherapy. Strategies and protocols useful for the expansion of NK cells may include interleukin 2 (IL2) stimulation and the use of autologous feeder cells, or the use of genetically modified allogeneic feeder cells. In some aspects, NK cells can be selectively expanded with a combination of stimulating ligands including IL15, IL21, IL2, 41BBL, IL12, IL18, MICA, 2B4, LFA-1, and BCM1/SLAMF2 (e.g., US patent publication NO: US20150190471).

Immune cells expressing effector modules comprising a CAR and/or other immunotherapeutic agents can be used as cancer immunotherapy. The immunotherapy comprises the cells expressing a CAR and/or other immunotherapeutic agents as an active ingredient, and may further comprise a suitable excipient. Examples of the excipient may include the aforementioned pharmaceutically acceptable excipients, including various cell culture media, and isotonic sodium chloride.

In some embodiments, cells of the present invention may be utilized as artificial antigen presenting cells to propagate and activate clinical grade T cells or NK cells for immunotherapy. As a non-limiting example, K562 erythroleukemia cells may be used for this purpose.

In some embodiments, cells of the present invention may be dendritic cells that are genetically modified to express the compositions of the invention. Such cells may be used as cancer vaccines.

In some embodiments, cells of the invention may be Treg cells. Payloads of the invention may be used to promote the proliferation, survival, activation and/or function of T regulatory cells. Tregs are a distinct population of cells that are positively selected on high affinity ligands in the thymus and play an important role in the tolerance to self-antigens. In addition, T regs have also been shown to play a role in peripheral tolerance to foreign antigens. The ability of Tregs to induce tolerance may be utilized to tune immune responses to the immunotherapeutic agents described herein. Methods for expanding Tregs for immunotherapy have been described by Tang et al., 2004, J. Exp. Med. 199: 1455-65; Battaglia et al., 2005, Blood 105: 4743-48; Earle et al., 2005, Clin. Immunol. 115: 3-9; Godfrey et al., 2004, Blood 104: 453-61; Hoffmann et al., 2004, Blood 104: 895-903.

Methods of CD19 Antibody Development and Characterization

In some embodiments, the present invention provides methods of producing CD19 antibodies, antibody fragments or variants. Such methods may include the steps of: (1) preparing a composition with CD19, (2) contacting a library of antibodies or antibody fragments or variable with the composition, and (3) identifying one or more CD19 antibodies. Also, provided herein are methods for identifying FMC63-distinct CD19 antibodies, antibody fragments or variable.

In some embodiments, the present invention provides methods of identifying CD19 scFvs. Such methods may involve screening phagemid libraries for CD19 scFvs. Phagemid libraries expressing recombinant scFvs associated with the surface of bacteria or bacteriophages are useful in the present inventions. Phagemid libraries may be generated by PCR implication of the polynucleotides encoding the heavy chain and the kappa light chain of the immunoglobulin IgM and infecting Cre recombinase positive bacteria with the vectors containing the PCR products at a high multiplicity of infection (MOI). The high MOI results in bacteria containing multiple phagemids, each of which encodes a different VH and VL genes, which can be recombined by the Cre recombinase. The resulting library that may be generated by recombination is approximately $10^8$ unique scFvs. In some instances, libraries of CD19 scFvs formatted into chimeric antigen receptor constructs may be screened to identify CD19scFvs useful in the present invention.

In some embodiments, scFvs immunologically specific to CD19 may be identified using cells that ectopically express full length, a fragment or a portion of CD19. Cell lines with low endogenous CD19 expression may be selected for ectopic expression. In some embodiments, the CD19 may be a naturally occurring isoform of human CD19.

In some embodiments, fusion proteins comprising the extracellular domains of CD19 (i.e. exon 1-exon 4) fused to the Fc region of human IgG1 (CD19sIg) are utilized to identify CD19 specific scFvs. Such fusion proteins have been described by Oliveira et al (2013) Journal of Translational Medicine 11:23; the contents of which are incorporated herein by reference in their entirety.

Also, provided herein are methods to identify FMC63-distinct scFvs, which include scFvs that are immunologically specific to and bind to an epitope of the CD19 antigen that is different or unlike the epitope of CD19 antigen that is bound by FMC63. In some embodiments, FMC63-distinct scFvs are identified by screening the scFv library with a complex consisting of human CD19 bound to FMC63. The CD19 of Rhesus macaque (*Macaca mulatta*) herein referred to as Rhesus CD19, bears 88% homology to the human CD19. Despite this high degree of homology, the Rhesus CD19 is not recognized by FMC63, indicating that the FMC63 epitope is in the region of human CD19 that is non-homologous to Rhesus CD19. Thus, in some embodiments, Rhesus CD19 may be used to screen scFv libraries for FMC63-distinct scFvs. Mutations in the region of Rhesus CD19 that is non-homologous to the human CD19 have been previously utilized to identify residues of human CD19 that confer binding to FMC63 (Sommermeyer et al. (2017) Leukemia February 16. doi: 10.1038/leu.2017.57). In some embodiments, the mutational analysis described by Sommermeyer et al. may be utilized to design human CD19 mutants that are unable to bind to FMC63. Such mutants may include human CD19 (H218R, A237D, M243V, E244D, P250T) and human CD19 (H218R, A237D) and may be utilized to screen scFv libraries for FMC63-distinct scFvs. Sotillo et al have identified a splice variant of human CD19 lacking exon 2 in cancer patients (Sotillo et al. (2015) Cancer Discov. 2015 December; 5(12): 1282-95). The splice variant lacking exon 2 is not recognized by FMC63 and may also be used to screen scFv libraries for FMC63-distinct scFvs.

CD19 IgG fusion molecules generated by fusing the Fc region of human IgG1 with the human CD19-complete extracellular domains, i.e., exons 1-4 (CD19sIgG1-4) or extracellular domains lacking exon 2, i.e., exons 1, 3 and 4

(CD19sIgG1,3,4) may also be utilized to screen scFv libraries for FMC63-distinct scFvs.

CD19 proteins, variants and mutants useful in the invention are provided in Table 42.

TABLE 42

CD19 proteins, variants and mutants

| Description | Sequence | SEQ ID NO |
|---|---|---|
| Human CD19, Isoform 1 (NCBI Reference No. NP_001171569.1) | MPPPRLLFFLLFLTPMEVRPEEPLVVKVEEGDNAVLQCLKGTSDGPTQQ LTWSRESPLKPFLKLSLGLPGLGIHMRPLAIWLFIFNVSQQMGGFYLCQ PGPPSEKAWQPGWTVNVEGSGELFRWNVSDLGGLGCGLKNRSSEGPSSP SGKLMSPKLYVWAKDRPEIWEGEPPCLPPRDSLNQSLSQDLTMAPGSTL WLSCGVPPDSVSRGPLSWTHVHPKGPKSLLSLELKDDRPARDMWVMETG LLLPRATAQDAGKYYCHRGNLTMSFHLEITARPVLWHWLLRTGGWKVSA VTLAYLIFCLCSLVGILHLQRALVLRRKRKRMTDPTRRFFKVTPPPGSG PQNQYGNVLSLPTPTSGLGRAQRWAAGLGGTAPSYGNPSSDVQADGALG SRSPPGVGPEEEEGEGYEEPDSEEDSEFYENDSNLGQDQLSQDGSGYEN PEDEPLGPEDEDSFSNAESYENEDEELTQPVARTMDFLSPHGSAWDPSR EATSLAGSQSYEDMRGILYAAPQLRSIRGQPGPNHEEDADSYENMDNPD GPDPAWGGGGRMGTWSTR | 3061 |
| Human CD19, Isoform 2 (NCBI Reference No. NP_001761.3) | MPPPRLLFFLLFLTPMEVRPEEPLVVKVEEGDNAVLQCLKGTSDGPTQQ LTWSRESPLKPFLKLSLGLPGLGIHMRPLAIWLFIFNVSQQMGGFYLCQ PGPPSEKAWQPGWTVNVEGSGELFRWNVSDLGGLGCGLKNRSSEGPSSP SGKLMSPKLYVWAKDRPEIWEGEPPCLPPRDSLNQSLSQDLTMAPGSTL WLSCGVPPDSVSRGPLSWTHVHPKGPKSLLSLELKDDRPARDMWVMETG LLLPRATAQDAGKYYCHRGNLTMSFHLEITARPVLWHWLLRTGGWKVSA VTLAYLIFCLCSLVGILHLQRALVLRRKRKRMTDPTRRFFKVTPPPGSG PQNQYGNVLSLPTPTSGLGRAQRWAAGLGGTAPSYGNPSSDVQADGALG SRSPPGVGPEEEEGEGYEEPDSEEDSEFYENDSNLGQDQLSQDGSGYEN PEDEPLGPEDEDSFSNAESYENEDEELTQPVARTMDFLSPHGSAWDPSR EATSLGSQSYEDMRGILYAAPQLRSIRGQPGPNHEEDADSYENMDNPDG PDPAWGGGGRMGTWSTR | 3062 |
| Rhesus CD19 (Uniprot ID: F7F486) | MPPPCLLFFLLFLTPMEVRPQEPLVVKVEEGDNAVLQCLEGTSDGPTQQ LVWCRDSPFEPFLNLSLGLPGMGIRMGPLGIWLLIFNVSNQTGGFYLCQ PGLPSEKAWQPGWTVSVEGSGELFRWNVSDLGGLGCGLKNRSSEGPSSP SGKLNSSQLYVWAKDRPEMWEGEPVCGPPRDSLNQSLSQDLTMAPGSTL WLSCGVPPDSVSRGPLSWTHVRPKGPKSSLLSLELKDDRPDRDMWVVDT GLLLTRATAQDAGKYYCHRGNWTKSFYLEITARPALWHWLLRIGGWKVP AVTLTYLIFCLCSLVGILQLQRALVLRRKRKRMTDPTRRFFKVTPPPGS GPQNQYGNVLSLPTPTSGLGRAQRWAAGLGGTAPSYGNPSSDVQVDGAV GSRSPPGAGPEEEEGEGYEEPDSEEGSEFYENDSNFGQDQLSQDGSGYE NPEDEPLGPEDEDSFSNAESYENEDEELTQPVARTMDFLSPHGSAWDPS REATSLGSQSYEDMRGLLYAAPQLRTIRGQPGPNHEEDADSYENMDNPD GPDPAWGGGGRMGTWSAR | 3063 |
| Human CD19 (H218R, A237D, M243V, E244D, P250T) | MPPPRLLFFLLFLTPMEVRPEEPLVVKVEEGDNAVLQCLKGTSDGPTQQ LTWSRESPLKPFLKLSLGLPGLGIHMRPLAIWLFIFNVSQQMGGFYLCQ PGPPSEKAWQPGWTVNVEGSGELFRWNVSDLGGLGCGLKNRSSEGPSSP SGKLMSPKLYVWAKDRPEIWEGEPPCLPPRDSLNQSLSQDLTMAPGSTL WLSCGVPPDSVSRGPLSWTHVRPKGPKSLLSLELKDDRPDRDMWVVDTG LLLTRATAQDAGKYYCHRGNLTMSFHLEITARPVLWHWLLRTGGWKVSA VTLAYLIFCLCSLVGILHLQRALVLRRKRKRMTDPTRRFFKVTPPPGSG PQNQYGNVLSLPTPTSGLGRAQRWAAGLGGTAPSYGNPSSDVQADGALG SRSPPGVGPEEEEGEGYEEPDSEEDSEFYENDSNLGQDQLSQDGSGYEN PEDEPLGPEDEDSFSNAESYENEDEELTQPVARTMDFLSPHGSAWDPSR EATSLAGSQSYEDMRGILYAAPQLRSIRGQPGPNHEEDADSYENMDNPD GPDPAWGGGGRMGTWSTR | 3064 |
| Human CD19 (H218R, A237D) | MPPPRLLFFLLFLTPMEVRPEEPLVVKVEEGDNAVLQCLKGTSDGPTQQ LTWSRESPLKPFLKLSLGLPGLGIHMRPLAIWLFIFNVSQQMGGFYLCQ PGPPSEKAWQPGWTVNVEGSGELFRWNVSDLGGLGCGLKNRSSEGPSSP SGKLMSPKLYVWAKDRPEIWEGEPPCLPPRDSLNQSLSQDLTMAPGSTL WLSCGVPPDSVSRGPLSWTHVRPKGPKSLLSLELKDDRPDRDMWVMETG LLLPRATAQDAGKYYCHRGNLTMSFHLEITARPVLWHWLLRTGGWKVSA VTLAYLIFCLCSLVGILHLQRALVLRRKRKRMTDPTRRFFKVTPPPGSG PQNQYGNVLSLPTPTSGLGRAQRWAAGLGGTAPSYGNPSSDVQADGALG SRSPPGVGPEEEEGEGYEEPDSEEDSEFYENDSNLGQDQLSQDGSGYEN PEDEPLGPEDEDSFSNAESYENEDEELTQPVARTMDFLSPHGSAWDPSR EATSLAGSQSYEDMRGILYAAPQLRSIRGQPGPNHEEDADSYENMDNPD GPDPAWGGGGRMGTWSTR | 3065 |
| Human CD19 (Delta exon 2) | MPPPRLLFFLLFLTPMEVRPEEPLVVKVEGELFRWNVSDLGGLGCGLKN RSSEGPSSPSGKLMSPKLYVWAKDRPEIWEGEPPCLPPRDSLNQSLSQD LTMAPGSTLWLSCGVPPDSVSRGPLSWTHVHPKGPKSLLSLELKDDRPA RDMWVMETGLLLPRATAQDAGKYYCHRGNLTMSFHLEITARPVLWHWLL RTGGWKVSAVTLAYLIFCLCSLVGILHLQRALVLRRKRKRMTDPTRRFF KVTPPPGSGPQNQYGNVLSLPTPTSGLGRAQRWAAGLGGTAPSYGNPSS DVQADGALGSRSPPGVGPEEEEGEGYEEPDSEEDSEFYENDSNLGQDQL SQDGSGYENPEDEPLGPEDEDSFSNAESYENEDEELTQPVARTMDFLSP | 3066 |

TABLE 42-continued

CD19 proteins, variants and mutants

| Description | Sequence | SEQ ID NO |
|---|---|---|
| | HGSAWDPSREATSLGSQSYEDMRGILYAAPQLRSIRGQPGPNHEEDADS YENMDNPDGPDPAWGGGRMGTWSTR | |
| Human CD19 (Exon 1-4) | MPPPRLLFFLLFLTPMEVRPEEPLVVKVEEGDNAVLQCLKGTSDGPTQQ LTWSRESPLKPFLKLSLGLPGLGIHMRPLAIWLFIFNVSQQMGGFYLCQ PGPPSEKAWQPGWTVNVEGSGELFRWNVSDLGGLGCGLKNRSSEGPSSP SGKLMSPKLYVWAKDRPEIWEGEPPCLPPRDSLNQSLSQDLTMAPGSTL WLSCGVPPDSVSRGPLSWTHVHPKGPKSLLSLELKDDRPARDMWVMETG LLLPRATAQDAGKYYCHRGNLTMSFHLEITARP | 3067 |
| Human CD19 (Exon 1, 3, 4) | MPPPRLLFFLLFLTPMEVRPEEPLVVKVEGELFRWNVSDLGGLGCGLKN RSSEGPSSPSGKLMSPKLYVWAKDRPEIWEGEPPCLPPRDSLNQSLSQD LTMAPGSTLWLSCGVPPDSVSRGPLSWTHVHPKGPKSLLSLELKDDRPA RDMWVMETGLLLPRATAQDAGKYYCHRGNLTMSFHLEITARP | 3068 |

III. Pharmaceutical Compositions and Formulations

The present invention further provides pharmaceutical compositions comprising one or more biocircuits, effector modules, SREs (e.g., DDs), stimuli and payloads of interest (i.e., immunotherapeutic agents), vectors, cells and other components of the invention, and optionally at least one pharmaceutically acceptable excipient or inert ingredient.

As used herein the term "pharmaceutical composition" refers to a preparation of biocircuits, SREs, stimuli and payloads of interest (i.e., immunotherapeutic agents), other components, vectors, cells and described herein, or pharmaceutically acceptable salts thereof, optionally with other chemical components such as physiologically suitable carriers and excipients. The pharmaceutical compositions of the invention comprise an effective amount of one or more active compositions of the invention. The preparation of a pharmaceutical composition that contains at least one composition of the present invention and/or an additional active ingredient will be known to those skilled in the art in light of the present disclosure, as exemplified by Remington's Pharmaceutical Sciences, 18th Ed. Mack Printing Company, 1990, incorporated herein by reference.

The term "excipient" or "inert ingredient" refers to an inactive substance added to a pharmaceutical composition and formulation to further facilitate administration of an active ingredient. For the purposes of the present disclosure, the phrase "active ingredient" generally refers to any one or more biocircuits, effector modules, SREs, stimuli and payloads of interest (i.e., immunotherapeutic agents), other components, vectors, and cells to be delivered as described herein. The phrases "pharmaceutically acceptable" refers to molecular entities and compositions that do not produce an adverse, allergic or other untoward reaction when administered to an animal, such as, for example, a human, as appropriate.

In some embodiments, pharmaceutical compositions and formulations are administered to humans, human patients or subjects. Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Subjects to which administration of the pharmaceutical compositions is contemplated include, but are not limited to, non-human mammals, including agricultural animals such as cattle, horses, chickens and pigs, domestic animals such as cats, dogs, or research animals such as mice, rats, rabbits, dogs and non-human primates. It will be understood that, for human administration, preparations should meet sterility, pyrogenicity, general safety and purity standards as required by FDA Office of Biological Standards.

A pharmaceutical composition and formulation in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

The compositions of the present invention may be formulated in any manner suitable for delivery. The formulation may be, but is not limited to, nanoparticles, poly (lactic-co-glycolic acid) (PLGA) microspheres, lipidoids, lipoplex, liposome, polymers, carbohydrates (including simple sugars), cationic lipids and combinations thereof.

In one embodiment, the formulation is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG and PEGylated lipids. In another aspect, the lipid may be a cationic lipid such as, but not limited to, DLin-DMA, DLin-D-DMA, DLin-MC3-DMA, DLin-KC2-DMA and DODMA.

For polynucleotides of the invention, the formulation may be selected from any of those taught, for example, in International Application PCT/US2012/069610, the contents of which are incorporated herein by reference in its entirety.

Relative amounts of the active ingredient, the pharmaceutically acceptable excipient or inert ingredient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1 and 100, e.g., between 0.5 and 50, between 1-30, between 5-80, at least 80 (w/w) active ingredient.

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of compositions of the present invention, "effective against" for example a cancer, indicates that administration in a clinically appropriate manner results in a beneficial effect for at least a statistically significant fraction of patients, such as an improvement of symptoms, a cure, a reduction in disease load, reduction in tumor mass or cell numbers, extension of life, improvement in quality of life, or other effect generally recognized as positive by medical doctors familiar with treating the particular type of cancer.

A treatment or preventive effect is evident when there is a statistically significant improvement in one or more parameters of disease status, or by a failure to worsen or to develop symptoms where they would otherwise be anticipated. As an example, a favorable change of at least 10 in a measurable parameter of disease, and preferably at least 20, 30, 40, 50 or more can be indicative of effective treatment. Efficacy for a given composition or formulation of the present invention can also be judged using an experimental animal model for the given disease as known in the art. When using an experimental animal model, efficacy of treatment is evidenced when a statistically significant change is observed.

Preferably, the compositions of the invention are administered by injection, e.g., intravenously. When the inventive CAR material is a host cell (or a population thereof) expressing the inventive CAR, the pharmaceutically acceptable carrier for the cells for injection may include any isotonic carrier such as, for example, normal saline (about 0.90% w/v of NaCl in water, about 300 mOsm/L NaCl in water, or about 9.0 g NaCl per liter of water), NORMOSOL R electrolyte solution (Abbott, Chicago, Ill.), PLASMA-LYTE A (Baxter, Deerfield, Ill.), about 5% dextrose in water, or Ringer's lactate. In an embodiment, the pharmaceutically acceptable carrier may be supplemented with human serum albumen. Any of the carriers taught in WO2016149578A1 may be useful in the present invention.

IV. Applications

In one aspect of the present invention, methods for reducing a tumor volume or burden are provided. The methods comprise administering a pharmaceutically effective amount of a pharmaceutical composition comprising at least one biocircuit system, effector module, DD, and/or payload of interest (i.e., an immunotherapeutic agent), at least one vector, or cells to a subject having a tumor. The biocircuit system and effector module having any immunotherapeutic agent as described herein may be in forms of a polypeptide, or a polynucleotide such as mRNA, or a viral vector comprising the polynucleotide, or a cell modified to express the biocircuit, effector module, DD, and payload of interest (i.e., immunotherapeutic agent).

In another aspect of the present invention, methods for inducing an anti-tumor immune response in a subject are provided. The methods comprise administering a pharmaceutically effective amount of a pharmaceutical composition comprising at least one biocircuit system, effector module, DD, and/or payload of interest (i.e., an immunotherapeutic agent), at least one vector, or cells to a subject having a tumor. The biocircuit and effector module having any immunotherapeutic agent as described herein may be in forms of a polypeptide, or a polynucleotide such as mRNA, or a viral vector comprising the polynucleotide, or a cell modified to express the biocircuit, effector module, DD, and payload of interest (i.e., immunotherapeutic agent).

The methods, according to the present invention, may be adoptive cell transfer (ACT) using genetically engineered cells such as immune effector cells of the invention, cancer vaccines comprising biocircuit systems, effector modules, DDs, payloads of interest (i.e., immunotherapeutic agents) of the invention, or compositions that manipulate the tumor immunosuppressive microenvironment, or the combination thereof. These treatments may be further employed with other cancer treatment such as chemotherapy and radiotherapy.

In some embodiments, the safety switches described herein may be useful in the treatment of diseases of protein proliferation and/or protein aggregation e.g. renal diseases and/or neurological diseases such as Alzheimer's diseases, prior diseases etc. In one embodiment, safety switches of the present invention may be expressed in phagocytic cells that are engineered to target aggregated proteins such as amyloid proteins, wherein the safety switches described herein may be used to eliminate the phagocytic cells after the clearance of the aggregated proteins.

1. Adoptive Cell Transfer (Adoptive Immunotherapy)

In some embodiments, cells which are genetically modified to express at least one biocircuit system, effector module, DD, and/or payload of interest (immunotherapeutic agent) may be used for adoptive cell therapy (ACT). As used herein, Adoptive cell transfer refers to the administration of immune cells (from autologous, allogenic or genetically modified hosts) with direct anticancer activity. ACT has shown promise in clinical application against malignant and infectious disease. For example, T cells genetically engineered to recognize CD19 have been used to treat follicular B cell lymphoma (Kochenderfer et al., *Blood*, 2010, 116: 4099-4102; and Kochenderfer and Rosenberg, *Nat Rev Clin Oncol.*, 2013, 10(5): 267-276) and ACT using autologous lymphocytes genetically-modified to express anti-tumor T cell receptors has been used to treat metastatic melanoma (Rosenberg and Dudley, *Curr. Opin. Immunol.* 2009, 21: 233-240).

According to the present invention, the biocircuits and systems may be used in the development and implementation of cell therapies such as adoptive cell therapy. Certain effector modules useful in cell therapy are given in FIG. 7-FIG. 12. The biocircuits, their components, effector modules and their SREs and payloads may be used in cell therapies to effect CAR therapies, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g. by introducing cytokine genes, genes for the checkpoint inhibitors PD1, CTLA4).

According to the present invention, the biocircuits and systems may be used in the development and implementation of cell therapies such as adoptive cell therapy. Certain effector modules useful in cell therapy are given in FIG. 7-FIG. 12. The biocircuits, their components, effector modules and their SREs and payloads may be used in cell therapies in APC platforms for stimulating T cells, as a tool to enhance ex vivo APC stimulation, to improve methods of T cell expansion, in ex vivo stimulation with antigen, in TCR/CAR combinations, in the manipulation or regulation of TILs, in allogeneic cell therapy, in combination T cell therapy with other treatment lines (e.g. radiation, cytokines), or to enhance T cells other than TCRs (e.g. by introducing cytokine genes).

According to the present invention, the biocircuits and systems may be used in the development and implementation of cell therapies such as adoptive cell therapy. Certain effector modules useful in cell therapy are given in FIG. 7-FIG. 12. The biocircuits, their components, effector modules and their SREs and payloads may be used in cell therapies to regulate epitope tagged receptors, in APC platforms for stimulating T cells, as a tool to enhance ex vivo APC stimulation, to improve methods of T cell expansion, in ex vivo stimulation with antigen, in TCR/CAR combinations, in the manipulation or regulation of TILs, in allogeneic cell therapy, in combination T cell therapy with other treatment lines (e.g. radiation, cytokines).

In one embodiment, the biocircuits, their components, effector modules and their SREs and payloads may be used to improve methods of T cell expansion and/or methods of increasing the length of expression of a payload. The methods may include the use of CD3/CD28 dynabeads. The dynabeads used may be expander dynabeads, activator dynabeads or a combination thereof. The dynabeads may be used at a ratio of dynabeads (B) to T cells (T) of 1:1, 1:2, 1:3, 1:4, 1:5, 1:6, 1:7, 1:8, 1:9, 1:10, 2:1, 2:3, 2:5, 2:7, 2:9, 3:1, 3:2, 3:4, 3:5, 3:7, 3:8, 3:10, 4:1, 4:3, 4:5, 4:7, 4:9, 5:1, 5:2, 5:3, 5:4, 5:6, 5:7, 5:8, 5:9, 6:1, 6:5, 6:7, 7:1, 7:2, 7:3, 7:4, 7:5, 7:6, 7:8, 7:9, 7:10, 8:1, 8:3, 8:5, 8:7, 8:9, 9:1, 9:2, 9:4, 9:5, 9:7, 9:8, 9:10, 10:1, 10:3, 10:7, and 10:9. In one embodiment, the B:T ratio is 3:1. In one embodiment, the B:T ratio is 1:1. In one embodiment, the B:T ratio is 1:2. In one embodiment, the B:T ratio is 1:3. In one embodiment, the B:T ratio is 2:1. As a non-limiting example, expander dynabeads are used at a B:T ratio of 3:1 and activator dynabeads are used at a B:T ratio of 3:1. As a non-limiting example, expander dynabeads are used at a B:T ratio of 2:1 and activator dynabeads are used at a B:T ratio of 3:1. As a non-limiting example, expander dynabeads are used at a B:T ratio of 1:1 and activator dynabeads are used at a B:T ratio of 3:1.

In some embodiments, the compositions of the present invention may be utilized to alter TIL (tumor infiltrating lymphocyte) populations in a subject. In one embodiment, any of the payloads described herein may be utilized to change the ratio of CD4 positive cells to CD8 positive populations. In some embodiments, TILs may be sorted ex vivo and engineered to express any of the cytokines described herein. Payloads of the invention e.g. IL15 or IL15-IL15Ra may be used to expand CD4 and/or CD8 populations of TILs to enhance TIL mediated immune response.

In some embodiments, the compositions of the present invention may be utilized to alter TIL (tumor infiltrating lymphocyte) populations in a subject. In one embodiment, any of the payloads described herein may be utilized to change the ratio of CD4 positive cells to CD8 positive populations. In some embodiments, TILs may be sorted ex vivo and engineered to express any of the cytokines described herein. Payloads of the invention e.g. IL12 may be used to expand CD4 and/or CD8 populations of TILs to enhance TIL mediated immune response. In some embodiments, compositions of the present invention may be used to enhance anti-tumor activity of chimeric antigen receptor e.g. CD19 CAR and MUC16 CAR and prolong survival in tumor bearing subjects (Koneru, et al. Oncoimmunology 2015 March; 4(3): e994446; the contents of which are incorporated by reference in its entirety).

Provided herein are methods for use in adoptive cell therapy. The methods involve preconditioning a subject in need thereof, modulating immune cells with SRE, biocircuits and compositions of the present invention, administering to a subject, engineered immune cells expressing compositions of the invention and the successful engraftment of engineered cells within the subject.

In some embodiments, SREs, biocircuits and compositions of the present invention may be used to minimize preconditioning regimens associated with adoptive cell therapy. As used herein "preconditioning" refers to any therapeutic regimen administered to a subject to improve the outcome of adoptive cell therapy. Preconditioning strategies include, but are not limited to total body irradiation and/or lymphodepleting chemotherapy. Adoptive therapy clinical trials without preconditioning have failed to demonstrate any clinical benefit, indicating its importance in ACT. Yet, preconditioning is associated with significant toxicity and limits the subject cohort that is suitable for ACT. In some instances, immune cells for ACT may be engineered to express payloads of the invention, for example, cytokines such as IL12 and IL15 as payload using SREs of the present invention to reduce the need for preconditioning (Pengram et al. (2012) Blood 119 (18): 4133-41; the contents of which are incorporated by reference in their entirety).

In some embodiments, SREs, biocircuits and compositions of the present invention may be used to minimize preconditioning regimens associated with adoptive cell therapy. As used herein "preconditioning" refers to any therapeutic regimen administered to a subject to improve the outcome of adoptive cell therapy. Preconditioning strategies include, but are not limited to total body irradiation and/or lymphodepleting chemotherapy. Adoptive therapy clinical trials without preconditioning have failed to demonstrate any clinical benefit, indicating its importance in ACT. Yet, preconditioning is associated with significant toxicity and limits the subject cohort that is suitable for ACT. In some instances, immune cells for ACT may be engineered to express payloads of the invention such as IL15 to reduce the need for preconditioning (Pengram et al. (2012) Blood 119 (18): 4133-41; the contents of which are incorporated by reference in their entirety).

In some embodiments, SREs, biocircuits and compositions of the present invention may be used to minimize preconditioning regimens associated with adoptive cell therapy. As used herein "preconditioning" refers to any therapeutic regimen administered to a subject to improve the outcome of adoptive cell therapy. Preconditioning strategies include, but are not limited to total body irradiation and/or lymphodepleting chemotherapy. Adoptive therapy clinical trials without preconditioning have failed to demonstrate any clinical benefit, indicating its importance in ACT. Yet, preconditioning is associated with significant toxicity and limits the subject cohort that is suitable for ACT. In some instances, immune cells for ACT may be engineered to express cytokines such as IL2 as payload using SREs of the present invention to reduce the need for preconditioning.

In some embodiments, immune cells for ACT may be dendritic cells, T cells such as $CD8^+$ T cells and $CD4^+$ T cells, natural killer (NK) cells, NK T cells, Cytotoxic T lymphocytes (CTLs), tumor infiltrating lymphocytes (TILs), lymphokine activated killer (LAK) cells, memory T cells, regulatory T cells (Tregs), helper T cells, cytokine-induced killer (CIK) cells, and any combination thereof. In other embodiments, immune stimulatory cells for ACT may be generated from embryonic stem cell (ESC) and induced pluripotent stem cell (iPSC). In some embodiments, autologous or allogeneic immune cells are used for ACT.

In some embodiments, cells used for ACT may be T cells engineered to express CARs comprising an antigen-binding domain specific to an antigen on tumor cells of interest. In other embodiments, cells used for ACT may be NK cells engineered to express CARs comprising an antigen-binding domain specific to an antigen on tumor cells of interest. In addition to adoptive transfer of genetically modified T cells (e.g., CAR T cells) for immunotherapy, alternate types of CAR-expressing leukocytes, either alone, or in combination with CAR T cells may be used for adoptive immunotherapy. In one example, a mixture of T cells and NK cells may be used for ACT. The expression level of CARs in T cells and NK cells, according to the present invention, is tuned and controlled by a small molecule that binds to the DD(s) operably linked to the CAR in the effector module.

In some embodiments, the CARs of the present invention may be placed under the transcriptional control of the T cell receptor alpha constant (TRAC) locus in the T cells to achieve uniform CAR expression while enhancing T cell potency. The TRAC locus may be disrupted using the CRISPR/Cas 9, zinc finger nucleases (ZFNs), TALENs followed by the insertion of the CAR construct. Methods of engineering CAR constructs directed to the TRAC locus are described in Eyquem J. et al (2017) Nature. 543(7643): 113-117 (the contents of which are incorporated herein by reference in their entirety).

In some embodiments, NK cells engineered to express the present compositions may be used for ACT. NK cell activation induces perforin/granzyme-dependent apoptosis in target cells. NK cell activation also induces cytokine secretion such as IFN-γ, TNF-α and GM-CSF. These cytokines enhance the phagocytic function of macrophages and their antimicrobial activity, and augment the adaptive immune response via up-regulation of antigen presentation by antigen presenting cells such as dendritic cells (DCs) (Reviewed by Vivier et al., *Nat. Immunol.,* 2008, 9(5): 503-510).

Other examples of genetic modification may include the introduction of chimeric antigen receptors (CARs) and the down-regulation of inhibitory NK cell receptors such as NKG2A.

NK cells may also be genetically reprogrammed to circumvent NK cell inhibitory signals upon interaction with tumor cells. For example, using CRISPR, ZFN, or TALEN to genetically modify NK cells to silence their inhibitory receptors may enhance the anti-tumor capacity of NK cells.

In some embodiments, tumor specific CD8+ T cells may be engineered to express regulatable IL12 to eradicate pre-established tumors and/or as cancer vaccine. Such methods are described by Kerkar S P, et al. (2010). Cancer Research 70(17): 6725-6734 and Kerkar S P et al. (2011) J Clin Invest 121(12): 4746-4757; the contents of each of which are incorporated by reference in their entirety.

Immune cells can be isolated and expanded ex vivo using a variety of methods known in the art. For example, methods of isolating and expanding cytotoxic T cells are described in U.S. Pat. Nos. 6,805,861 and 6,531,451; US Patent Publication No.: US20160348072A1 and International Patent Publication NO: WO2016168595A1; the contents of each of which are incorporated herein by reference in their entirety. Isolation and expansion of NK cells is described in US Patent Publication NO.: US20150152387A1, U.S. Pat. No. 7,435,596; and Oyer, J. L. (2016). Cytotherapy. 18(5):653-63; the contents of each of which are incorporated by reference herein in its entirety. Specifically, human primary NK cells may be expanded in the presence of feeder cells e.g. a myeloid cell line that has been genetically modified to express membrane bound IL15, IL21, IL12 and 4-1BBL.

In some instances, sub populations of immune cells may be enriched for ACT. Methods for immune cell enrichment are taught in International Patent Publication No.: WO2015039100A1. In another example, T cells positive for B and T lymphocyte attenuator marker BTLA) may be used to enrich for T cells that are anti-cancer reactive as described in U.S. Pat. No. 9,512,401 (the content of each of the above disclosures are incorporated herein by reference in their entireties).

In some embodiments, immune cells for ACT may be depleted of select sub populations to enhance T cell expansion. For example, immune cells may be depleted of Foxp3+T lymphocytes to minimize the ant-tumor immune response using methods taught in US Patent Publication NO.: US 20160298081A1; the contents of which are incorporated by reference herein in their entirety.

In some embodiments, immune cells may be enriched for FOXP3+ cells to enrich for T cells that are critical for immune tolerance to reduce graft versus host disease.

In some embodiments, activation and expansion of T cells for ACT is achieved antigenic stimulation of a transiently expressed Chimeric Antigen Receptor (CAR) on the cell surface. Such activation methods are taught in International Patent NO.: WO2017015427, the content of which are incorporated herein by reference in their entirety.

In some embodiments, activation and expansion of T cells for ACT is achieved by a transiently expressed Chimeric Antigen Receptor (CAR) on the cell surface. Such activation methods are taught in International Patent NO. WO2017015427, the content of which are incorporated herein by reference in their entirety.

In some embodiments, immune cells may be activated by antigens associated with antigen presenting cells (APCs). In some embodiments, the APCs may be dendritic cells, macrophages or B cells that antigen specific or nonspecific. The APCs may autologous or homologous in their organ. In some embodiments, the APCs may be artificial antigen presenting cells (aAPCs) such as cell based aAPCs or acellular aAPCs. Cell based aAPCs are may be selected from either genetically modified allogeneic cells such as human erythroleukemia cells or xenogeneic cells such as murine fibroblasts and *Drosophila* cells. Alternatively, the APCs maybe be acellular wherein the antigens or costimulatory domains are presented on synthetic surfaces such as latex beads, polystyrene beads, lipid vesicles or exosomes.

In some embodiments, cells of the invention, specifically T cells may be expanded using artificial cell platforms. In one embodiment, the mature T cells may be generated using artificial thymic organoids (ATOs) described by Seet C S et al. 2017. Nat Methods. 14, 521-530 (the contents of which are incorporated herein by reference in their entirety). ATOs are based on a stromal cell line expressing delta like canonical notch ligand (DLL1). In this method, stromal cells are aggregated with hematopoietic stem and progenitor cells by centrifugation and deployed on a cell culture insert at the air-fluid interface to generate organoid cultures. ATO-derived T cells exhibit naive phenotypes, a diverse T cell receptor (TCR) repertoire and TCR-dependent function.

In some embodiments, the T cells of the invention may be separated from peripheral blood by a process known as apheresis, which separates lymphocytes from plasma, platelets and RBCs, and granulocytes. Lymphocyte in peripheral blood cells may further be separated from monocytes using a semi-automated elutriation device. T cells may also be enriched by magnetic selection with anti CD3/CD28 beads.

In one embodiment, an additional step of using a plastic adherent surface to deplete monocytes from the PBMCs may be utilized. Methods of T cell enrichment are disclosed in Stroncek D F et al. (2017) Journal of Translational Medicine. 15:59; the contents of which are incorporated by reference in its entirety.

In some embodiments, adoptive cell therapy is carried out by autologous transfer, wherein the cells are derived from a subject in need of a treatment and the cells, following isolation and processing are administered to the same subject. In other instances, ACT may involve allogenic transfer wherein the cells are isolated and/or prepared from a donor subject other than the recipient subject who ultimately receives cell therapy. The donor and recipient subject may be genetically identical, or similar or may express the same HLA class or subtype.

In some embodiments, the multiple immunotherapeutic agents introduced into the immune cells for ACT (e.g., T cells and NK cells) may be controlled by the same biocircuit system. In one example, a cytokine such as IL12 and a CAR construct such as CD19 CAR are linked to the same hDHFR destabilizing domain. The expression of IL12 and CD19 CAR is tuned using TMP simultaneously. In other embodiments, the multiple immunotherapeutic agents introduced into the immune cells for ACT (e.g., T cells and NK cells) may be controlled by different biocircuit systems. In one example, a cytokine such as IL12 and a CAR construct such as CD19 CAR are linked to different DDs in two separate effector modules, thereby can be tuned separately using different stimuli. In another example, a cytokine such as IL12 and a IL15 or IL15/IL15Ra are linked to different DDs in two separate effector modules, thereby can be tuned separately using different stimuli. In another example, a suicide gene and a CAR construct may be linked to two separate effector modules.

In some embodiments, the multiple immunotherapeutic agents introduced into the immune cells for ACT (e.g., T cells and NK cells) may be controlled by the same biocircuit system. In one example, a cytokine such as IL15 and a CAR construct such as CD19 CAR are linked to the same hDHFR destabilizing domain. The expression of IL15 and CD19 CAR is tuned using TMP simultaneously. In other embodiments, the multiple immunotherapeutic agents introduced into the immune cells for ACT (e.g., T cells and NK cells) may be controlled by different biocircuit systems. In one example, a cytokine such as IL15 and a CAR construct such as CD19 CAR are linked to different DDs in two separate effector modules, thereby can be tuned separately using different stimuli.

In some embodiments, the multiple immunotherapeutic agents introduced into the immune cells for ACT (e.g., T cells and NK cells) may be controlled by the same biocircuit system. In one example, a cytokine such as IL2 and a Caspase 9 are linked to the same hDHFR destabilizing domain. The expression of IL2 and Caspase 9 is tuned using TMP simultaneously. In other embodiments, the multiple immunotherapeutic agents introduced into the immune cells for ACT (e.g., T cells and NK cells) may be controlled by different biocircuit systems. In one example, a cytokine such as IL2 and Caspase 9 constructs are linked to different DDs in two separate effector modules, and can be tuned separately using different stimuli. In another example, a suicide gene and a CAR construct may be linked to two separate effector modules.

Following genetic modulation using SREs, biocircuits and compositions of the invention, cells are administered to the subject in need thereof. Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) Nat Rev Clin Oncol. 8(10): 577-85). See, e.g., Themeli et al. (2013) Nat Biotechnol. 31(10): 928-933; Tsukahara et al. (2013) Biochem Biophys Res Commun 438(1): 84-9; Davila et al. (2013) PLoS ONE 8(4): e61338; the contents of each of which are incorporated herein by reference in their entirety.

In some embodiments, immune cells for ACT may be modified to express one or more immunotherapeutic agents which facilitate immune cells activation, infiltration, expansion, survival and anti-tumor functions.

In some embodiments, immune cells for ACT may be modified to express one or more immunotherapeutic agents which facilitate immune cells activation, infiltration, expansion, survival and anti-tumor functions. The immunotherapeutic agents may be a second CAR or TCR specific to a different target molecule; a cytokine or a cytokine receptor; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed.

In some embodiments, immune cells for ACT may also be modified to express one or more immunotherapeutic agents which facilitate immune cells activation, infiltration, expansion, survival and anti-tumor functions. The immunotherapeutic agents may be a CAR or TCR specific to a different target molecule; a cytokine or a cytokine receptor; a chimeric switch receptor that converts an inhibitory signal to a stimulatory signal; a homing receptor that guides adoptively transferred cells to a target site such as the tumor tissue; an agent that optimizes the metabolism of the immune cell; or a safety switch gene (e.g., a suicide gene) that kills activated T cells when a severe event is observed after adoptive cell transfer or when the transferred immune cells are no-longer needed.

In some embodiments, immune cells used for adoptive cell transfer can be genetically manipulated to improve their persistence, cytotoxicity, tumor targeting capacity, and ability to home to disease sites in vivo, with the overall aim of further improving upon their capacity to kill tumors in cancer patients. One example is to introduce effector modules of the invention comprising cytokines such as gamma-cytokines (IL2 and IL15) into immune cells to promote immune cell proliferation and survival. Transduction of cytokine genes (e.g., gamma-cytokines IL2 and IL15) into cells will be able to propagate immune cells without addition of exogenous cytokines and cytokine expressing NK cells have enhanced tumor cytotoxicity.

In some embodiments, immune cells used for adoptive cell transfer can be genetically manipulated to improve their persistence, cytotoxicity, tumor targeting capacity, and ability to home to disease sites in vivo, with the overall aim of further improving upon their capacity to kill tumors in cancer patients. One example is to introduce effector modules of the invention comprising cytokines such as gamma-cytokines (IL15) into immune cells to promote immune cell proliferation and survival. Transduction of cytokine genes (e.g., IL15) into cells will be able to propagate immune cells without addition of exogenous cytokines and cytokine expressing NK cells have enhanced tumor cytotoxicity.

In some embodiments, immune cells used for adoptive cell transfer can be genetically manipulated to improve their persistence, cytotoxicity, tumor targeting capacity, and ability to home to disease sites in vivo, with the overall aim of further improving upon their capacity to kill tumors in cancer patients. One example is to introduce effector modules of the invention comprising cytokines such as gamma-cytokines (IL2) into immune cells to promote immune cell proliferation and survival. Transduction of cytokine genes (e.g., gamma-cytokines IL2) into cells will be able to propagate immune cells without addition of exogenous cytokines and cytokine expressing NK cells have enhanced tumor cytotoxicity.

NK cells may also be modified to become insensitive to suppressive cytokines such as TGF-β, thereby preserving their cytotoxicity. For example, NK cells can be genetically modified to express the dominant negative mutant form of TGF-β type II receptor (DNTPβRII) on their surface that render NK cells resistant to the suppressive effects of TGF-β.

In some embodiments, biocircuits, their components, SREs or effector modules may be utilized to prevent T cell exhaustion. As used herein, "T cell exhaustion" refers to the stepwise and progressive loss of T cell function caused by chronic T cell activation. T cell exhaustion is a major factor limiting the efficacy of antiviral and antitumor immunotherapies. Exhausted T cells have low proliferative and cytokine producing capabilities concurrent with high rates of apoptosis and high surface expression of multiple inhibitory receptors. T cell activation leading to exhaustion may occur either in the presence or absence of the antigen.

In some embodiments, the biocircuits, and their components may be utilized to prevent T cell exhaustion in the context of Chimeric Antigen Receptor-T cell therapy (CAR-T). In this context, exhaustion in some instances, may be caused by the oligomerization of the scFvs of the CAR on the cell surface which leads to continuous activation of the intracellular domains of the CAR. As a non-limiting example, CARs of the present invention may include scFvs that are unable to oligomerize. As another non-limiting example, CARs that are rapidly internalized and re-expressed following antigen exposure may also be selected to prevent chronic scFv oligomerization on cell surface. In one embodiment, the framework region of the scFvs may be modified to prevent constitutive CAR signaling (Long et al. 2014. Cancer Research. 74(19) S1; the contents of which are incorporated by reference in their entirety). Tunable biocircuit systems of the present invention may also be used to regulate the surface expression of the CAR on the T cell surface to prevent chronic T cell activation. The CARs of the invention may also be engineered to minimize exhaustion. As a non-limiting example, the 41-BB signaling domain may be incorporated into CAR design to ameliorate T cell exhaustion. In some embodiments, any of the strategies disclosed by Long H A et al. may be utilized to prevent exhaustion (Long A H et al. (2015) Nature Medicine 21, 581-590; the contents of which are incorporated herein by reference in their entirety).

In some embodiments, the tunable nature of the biocircuits of the present invention may be utilized to reverse human T cell exhaustion observed with tonic CAR signaling. Reversibly silencing the biological activity of adoptively transferred cells using compositions of the present invention may be used to reverse tonic signaling which, in turn, may reinvigorate the T cells. Reversal of exhaustion may be measured by the downregulation of multiple inhibitory receptors associated with exhaustion.

In some embodiments, T cell metabolic pathways may be modified to diminish the susceptibility of T cells to exhaustion. Metabolic pathways may include, but are not limited to glycolysis, urea cycle, citric acid cycle, beta oxidation, fatty acid biosynthesis, pentose phosphate pathway, nucleotide biosynthesis, and glycogen metabolic pathways. As a non-limiting example, payloads that reduce the rate of glycolysis may be utilized to restrict or prevent T cell exhaustion (Long et al. Journal for Immunotherapy of Cancer 2013, 1(Suppl 1): P21; the contents of which are incorporated by reference in their entirety). In one embodiment, T cells of the present invention may be used in combination with inhibitors of glycolysis such as 2-deoxyglucose, and rapamycin.

In some embodiments, effector modules of the present invention, useful for immunotherapy may be placed under the transcriptional control of the T cell receptor alpha locus constant (TRAC) locus in the T cells. Eyquem et al. have shown that expression of the CAR from the TRAC locus prevents T cell exhaustion and the accelerated differentiation of T cells caused by excessive T cell activation (Eyquem J. et al (2017) Nature. 543(7643): 113-117; the contents of which are incorporated herein by reference in their entirety).

In some embodiments, payloads of the invention may be used in conjunction with antibodies or fragments that target T cell surface markers associated with T cell exhaustion. T-cell surface markers associated with T cell exhaustion that may be used include, but are not limited to, CTLA-1, PD-1, TGIT, LAG-3, 2B4, BTLA, TIM3, VISTA, and CD96.

In one embodiment, the payload of the invention may be a CD276 CAR (with CD28, 4-IBB, and CD3 zeta intracellular domains), that does not show an upregulation of the markers associated with early T cell exhaustion (see International patent publication No. WO2017044699; the contents of which are incorporated by reference in their entirety).

T cells that are specific to certain tumor antigens, may be subject to chronic antigen exposure. Persistent antigen expression can lead to immune check-point expression, which in turn, induces a state of exhaustion among cognate antigen specific T cells. Constant expression of the chimeric antigen receptors of the invention may result in chronic interaction with the antigen, which leads to exhaustion. The compositions disclosed herein may be used to prevent T cell exhaustion by modulating surface CAR expression using the stimulus specific to the invention. In one embodiment, the SREs of the present invention may be used to achieve pulsatile expression of the compositions of the invention. As used here, "pulsatile" refers to a plurality of payload expression at spaced apart time intervals. Generally, upon administration of the stimulus, the expression of the payload is increased causing the first pulse; following the withdrawal of the stimulus, the expression of the payload decreases and this represents the interval time between the first exposure and the next exposure to the stimulus, after which the second exposure to the stimulus is initiated.

Also provided herein, is a method of preventing or reversing T cell exhaustion in a subject in need thereof, where the method comprising administering to the subject a therapeutically effective amount of a composition comprising at least one effector module. In some embodiments, the effector module includes a stimulus response element (SRE) operably linked to at least one immunotherapeutic agent, such that the SRE responds to a stimulus and tunes the expression and/or function of the immunotherapeutic agent, thereby preventing or reversing T cell exhaustion. In some embodiments, the immunotherapeutic agent may be a chimeric antigen receptor. Examples of chimeric antigen receptors include, but are not limited to GD2 CAR, BCMA CAR, CD33 CAR, Her2 CAR, ALK CAR, CD22 CAR, or a CD276 CAR. In some embodiments, the CAR may be a bispecific CAR comprising an extracellular domain which recognizes at least one antigen such as GD2, BCMA, CD33, Her2, ALK, CD22 or a CD276. In some embodiments, the methods described herein may include pulsatile expression of the compositions of the invention to prevent T cell exhaustion. In some instances, T cell exhaustion may be reversed by the addition of the stimulus. In other instances, T cell exhaustion may be reversed by the withdrawal of the stimulus.

In some embodiments, the compositions of the present invention may be utilized to alter TIL (tumor infiltrating lymphocyte) populations in a subject. In one embodiment, any of the payloads described herein may be utilized to change the ratio of CD4 positive cells to CD8 positive populations. In some embodiments, TILs may be sorted ex vivo and engineered to express any of the cytokines described herein. Payloads of the invention may be used to expand CD4 and/or CD8 populations of TILs to enhance TIL mediated immune response.

2. Cancer Vaccines

In some embodiments, biocircuits, effector modules, payloads of interest (immunotherapeutic agents), vectors, cells and compositions of the present invention may be used in conjunction with cancer vaccines.

In some embodiments, biocircuits, effector modules, payloads of interest (immunotherapeutic agents), vectors, cells and compositions of the present invention may be used in conjunction with cancer vaccines. In one aspect, dendritic cells are modified to express the compositions of the invention and used as cancer vaccines.

In some embodiments, cancer vaccine may comprise peptides and/or proteins derived from tumor associated antigen (TAA). Such strategies may be utilized to evoke an immune response in a subject, which in some instances may be a cytotoxic T lymphocyte (CTL) response. Peptides used for cancer vaccines may also be modified to match the mutation profile of a subject. For example, EGFR derived peptides with mutations matched to the mutations found in the subject in need of therapy have been successfully used in patients with lung cancer (Li F et al. (2016) Oncoimmunology. October 7; 5(12): e1238539; the contents of which are incorporated herein by reference in their entirety).

In one embodiment, cancer vaccines of the present invention may superagonist altered peptide ligands (APL) derived from TAAs. These are mutant peptide ligands deviate from the native peptide sequence by one or more amino acids, which activate specific CTL clones more effectively than native epitopes. These alterations may allow the peptide to bind better to the restricting Class I MHC molecule or interact more favorably with the TCR of a given tumor-specific CTL subset. APLs may be selected using methods taught in US Patent Publication NO.: US20160317633A1, the contents of which are incorporated herein by reference in their entirety.

Relapse of hematologic malignancies is the primary cause of treatment failure after allogeneic hematopoietic stem cell transplantation (HCT). The Wilm's tumor (WT1) gene product is a tumor associated antigen that is expressed in acute leukemia and other hematological malignancies, with limited expression in normal tissues. The compositions of the present invention may be co-administered with donor derived WT1 peptide loaded dendritic cell vaccine to prevent relapse of disease following immunotherapy (Shah N N et al. (2016) Biol Blood Marrow Transplant. 22(12):2149-215; the contents of which are incorporated herein by reference in their entirety).

3. Combination Treatments

In some embodiments, it is desirable to combine compositions, vectors and cells of the invention for administration to a subject. Compositions of the invention comprising different immunotherapeutic agents may be used in combination for enhancement of immunotherapy. Compositions of the invention comprising different immunotherapeutic agents may be used in combination or in conjunction with known immunotherapeutic agents for enhancement of immunotherapy.

In some embodiments, it is desirable to combine compositions of the invention with adjuvants, that can enhance the potency and longevity of antigen-specific immune responses. Adjuvants used as immunostimulants in combination therapy include biological molecules or delivery carriers that deliver antigens. As non-limiting examples, the compositions of the invention may be combined with biological adjuvants such as cytokines, Toll Like Receptors, bacterial toxins, and/or saponins. In other embodiments, the compositions of the present invention may be combined with delivery carriers. Exemplary delivery carriers include, polymer microspheres, immune stimulating complexes, emulsions (oil-in-water or water-in-oil), aluminum salts, liposomes or virosomes.

In some embodiments, immune effector cells modified to express biocircuits, effector modules, DDs and payloads of the invention may be combined with the biological adjuvants described herein. Dual regulation of CAR and cytokines and ligands to segregate the kinetic control of target-mediated activation from intrinsic cell T cell expansion. Such dual regulation also minimizes the need for pre-conditioning regimens in patients. As a non-limiting example, DD regulated CAR e.g. CD19 CAR may be combined with cytokines e.g. IL12 to enhance the anti-tumor efficacy of the CAR (Pegram H. J., et al. Tumor-targeted T cells modified to secrete IL12 eradicate systemic tumors without need for prior conditioning. Blood. 2012; 119:4133-41; the contents of each of which are incorporated herein by reference in their entirety). As another non-limiting example, Merchant et al. combined dendritic cell-based vaccinations with recombinant human IL7 to improve outcome in high-risk pediatric sarcomas patients (Merchant, M. S et. al. Adjuvant immunotherapy to Improve Outcome in High-Risk Pediatric Sarcomas. Clin Cancer Res. 2016. 22(13):3182-91; the contents of each of which are incorporated herein by reference in their entirety).

In some embodiments, immune effector cells modified to express biocircuits, effector modules, DDs and payloads of the invention may be combined with the biological adjuvants described herein. Dual regulation of CAR and cytokines and ligands to segregate the kinetic control of target-mediated activation from intrinsic cell T cell expansion. Such dual regulation also minimizes the need for pre-conditioning regimens in patients. As a non-limiting example, CAR e.g. CD19 CAR may be combined with DD regulated cytokines e.g. IL12 to enhance the anti-tumor efficacy of the CAR (Pegram H. J., et al. Tumor-targeted T cells modified to secrete IL12 eradicate systemic tumors without need for prior conditioning. Blood. 2012; 119:4133-41; the contents of each of which are incorporated herein by reference in their entirety).

In some embodiments, immune effector cells modified to express biocircuits, effector modules, DDs and payloads of the invention may be combined with the biological adjuvants described herein. Dual regulation of Chimeric Antigen Receptor (CAR) and cytokines and ligands may be used to segregate the kinetic control of target-mediated activation from intrinsic cell T cell expansion. Such dual regulation also minimizes the need for pre-conditioning regimens in patients. As a non-limiting example, DD regulated CAR e.g. CD19 CAR may be combined with cytokines e.g. IL15 to enhance the anti-tumor efficacy of the CAR.

In some embodiments, immune effector cells modified to express one or more antigen-specific TCRs or CARs may be combined with compositions of the invention comprising immunotherapeutic agents that convert the immunosuppressive tumor microenvironment.

In one aspect, effector immune cells modified to express CARs specific to different target molecules on the same cell may be combined. In another aspect, different immune cells modified to express the same CAR construct such as NK cells and T cells may be used in combination for a tumor treatment, for instance, a T cell modified to express a CD19 CAR may be combined with a NK cell modified to express the same CD19 CAR to treat B cell malignancy.

In one aspect, effector immune cells modified to express payloads of the invention may be combined with CARs specific to different target molecules on the same cell. In another aspect, different immune cells modified to express the CAR construct such as NK cells and T cells may be used in combination with immune cells expressing the payloads of the invention for a tumor treatment. For instance, a T cell modified to express a CD19 CAR may be combined with a NK cell modified to express the same CD19 CAR to treat B cell malignancy to be used in conjunction with T cells expressing IL15 or IL15-IL15Ra fusion proteins.

In one aspect, effector immune cells modified to express payloads of the invention may be combined with CARs specific to different target molecules on the same cell may be combined. In another aspect, different immune cells modified to express the CAR construct such as NK cells and T cells may be used in combination with immune cells of the invention for a tumor treatment, for instance, a T cell modified to express a CD19 CAR may be combined with a NK cell modified to express the same DD-1L12 to treat B cell malignancy. In other embodiments, immune cells modified to express compositions of the invention may be combined with checkpoint blockade agents.

In other embodiments, immune cells modified to express CARs may be combined with checkpoint blockade agents.

In other embodiments, immune cells modified to express payloads of the invention may be combined with checkpoint blockade agents.

In some embodiments, immune effector cells modified to expressed biocircuits, effector modules, DDs and payloads of the invention may be combined with cancer vaccines of the invention.

In some embodiments, immune effector cells modified to expressed biocircuits, effector modules, DDs and payloads of the invention may be combined with cancer vaccines.

In some embodiments, an effector module comprising a cytokine may be used in combination with an effector module encoding a safety switch or a regulatory switch.

In some embodiments, an effector module comprising a cytokines may be used in combination with an effector module comprising a different cytokine, or an effector module comprising a safety switch, or an effector module comprising a metabolic factor, or an effector module comprising a homing receptor.

In some embodiments, effector modules of the invention may be used in combination with a cytokine other than IL15 and IL15-IL15Ra fusion proteins, such as a Chimeric antigen receptor, or a safety switch, or a metabolic factor, or an effector module comprising a homing receptor.

In some embodiments, methods of the invention may include combination of the compositions of the invention with other agents effective in the treatment of cancers, infection diseases and other immunodeficient disorders, such as anti-cancer agents. As used herein, the term "anti-cancer agent" refers to any agent which is capable of negatively affecting cancer in a subject, for example, by killing cancer cells, inducing apoptosis in cancer cells, reducing the growth rate of cancer cells, reducing the incidence or number of metastases, reducing tumor size, inhibiting tumor growth, reducing the blood supply to a tumor or cancer cells, promoting an immune response against cancer cells or a tumor, preventing or inhibiting the progression of cancer, or increasing the lifespan of a subject with cancer.

In some embodiments, anti-cancer agent or therapy may be a chemotherapeutic agent, or radiotherapy, immunotherapeutic agent, surgery, or any other therapeutic agent which, in combination with the present invention, improves the therapeutic efficacy of treatment.

In one embodiment, an effector module comprising a CD19 CAR may be used in combination with amino pyrimidine derivatives such as the Burkit's tyrosine receptor kinase (BTK) inhibitor using methods taught in International Patent Application NO.: WO2016164580, the contents of which are incorporated herein by reference in their entirety.

In one embodiment, an effector module comprising a IL15 or IL15-IL15Ra fusion proteins may be used in combination with amino pyrimidine derivatives such as the Burkit's tyrosine receptor kinase (BTK) inhibitor using methods taught in International Patent Application NO. WO2016164580, the contents of which are incorporated herein by reference in their entirety.

In one embodiment, an effector module comprising a IL12 may be used in combination with amino pyrimidine derivatives such as the Burkit's tyrosine receptor kinase (BTK) inhibitor using methods taught in International Patent Application NO. WO2016164580, the contents of which are incorporated herein by reference in their entirety.

In some embodiments, compositions of the present invention may be used in combination with immunotherapeutics other than the inventive therapy described herein, such as antibodies specific to some target molecules on the surface of a tumor cell.

Exemplary chemotherapies include, without limitation, Acivicin; Aclarubicin; Acodazole hydrochloride; Acronine; Adozelesin; Aldesleukin; Altretamine; Ambomycin; Ametantrone acetate; Amsacrine; Anastrozole; Anthramycin; Asparaginase; Asperrin, Sulindac, Curcumin, alkylating agents including: Nitrogen mustards such as mechlorethamine, cyclophosphamide, ifosfamide, melphalan and chlorambucil; nitrosoureas such as carmustine (BC U), lomustine (CCNU), and semustine (methyl-CC U); thylenimines/methylmelamine such as thriethylenemelamine (TEM), triethylene, thiophosphoramide (thiotepa), hexamethylmelamine (HMM, altretamine); alkyl sulfonates such as busulfan; triazines such as dacarbazine (DTIC); antimetabolites including folic acid analogs such as methotrexate and trimetrexate, pyrrolidine analogs such as 5-fluorouracil, fluorodeoxyuridine, gemcitabine, cytosine arabinoside (AraC, cytarabine), 5-azacytidine, 2,2'-difluorodeoxycytidine, purine analogs such as 6-mercaptopurine, 6-thioguanine, azathioprine, 2'-deoxycoformycin (pentostatin), erythrohydroxynonyladenine (EHNA), fludarabine phosphate, and 2-chlorodeoxyadenosine (cladribine, 2-CdA); natural products including antimitotic drugs such as paclitaxel, vinca alkaloids including vinblastine (VLB), vincristine, and vinorelbine, taxotere, estramustine, and estramustine phosphate; epipodophylotoxins such as etoposide and teniposide; antibiotics, such as actimomycin D, daunomycin (rubidomycin), doxorubicin, mitoxantrone, idarubicin, bleomycins, plicamycin (mithramycin), mitomycinC, and actinomycin; enzymes such as L-asparaginase, cytokines such as interferon (IFN)-gamma, tumor necrosis factor (TNF)-alpha, TNF-beta and GM-CSF, anti-angiogenic factors, such as angiostatin and endostatin, inhibitors of FGF or VEGF such as soluble forms of receptors for angiogenic factors, including soluble VGF/VEGF receptors, platinum coordination complexes such as cisplatin and carboplatin, anthracenediones such as mitoxantrone, substituted urea such as hydroxyurea, methylhydrazine derivatives including N-methylhydrazine (MIFf) and procarbazine, adrenocortical suppressants such as mitotane (o,p'-DDD) and aminoglutethimide; hormones and antagonists including adrenocorticosteroid antagonists such as prednisone and equivalents, dexamethasone and aminoglutethimide; progestin such as hydroxyprogesterone caproate, medroxyprogesterone acetate and megestrol acetate; estrogen such as diethylstilbestrol and ethinyl estradiol equivalents; antiestrogen such as tamoxifen; androgens including testosterone propionate and fluoxymesterone/equivalents; antiandrogens such as flutamide, gonadotropin-releasing hormone analogs and leuprolide; non-steroidal antiandrogens such as flutamide; kinase inhibitors, histone deacetylase inhibitors, methylation inhibitors, proteasome inhibitors, monoclonal antibodies, oxidants, anti-oxidants, telomerase inhibitors, BH3 mimetics, ubiquitin ligase inhibitors, stat inhibitors and receptor tyrosin kinase inhibitors such as imatinib mesylate (marketed as Gleevac or Glivac) and erlotinib (an EGF receptor inhibitor) now marketed as Tarveca; anti-virals such as oseltamivir phosphate, Amphotericin B, and palivizumab; Sdi 1 mimetics; Semustine; Senescence derived inhibitor 1; Sparfosic acid; Spicamycin D; Spiromustine; Splenopentin; Spongistatin 1; Squalamine; Stipiamide; Stromelysin inhibitors; Sulfinosine; Superactive vasoactive intestinal peptide antagonist; Velaresol; Veramine; Verdins; Verteporfin; Vinorelbine; Vinxaltine; Vitaxin; Vorozole; Zanoterone; Zeniplatin; Zilascorb; and Zinostatin stimalamer; PI3KP3 small-molecule inhibitor, GSK2636771; pan-PI3K inhibitor (BKM120); BRAF inhibitors. Vemurafenib (Zelboraf) and dabrafenib (Tafinlar); or any analog or derivative and variant of the foregoing.

Radiotherapeutic agents and factors include radiation and waves that induce DNA damage for example, γ-irradiation, X-rays, UV-irradiation, microwaves, electronic emissions, radioisotopes, and the like. Therapy may be achieved by irradiating the localized tumor site with the above described forms of radiations. It is most likely that all of these factors effect a broad range of damage DNA, on the precursors of DNA, the replication and repair of DNA, and the assembly and maintenance of chromosomes. Dosage ranges for X-rays range from daily doses of 50 to 200 roentgens for prolonged periods of time (3 to 4 weeks), to single doses of 2000 to 6000 roentgens. Dosage ranges for radioisotopes vary widely, and depend on the half-life of the isotope, the strength and type of radiation emitted, and the uptake by the neoplastic cells.

In some embodiments, the chemotherapeutic agent may be an immunomodulatory agent such as lenalidomide (LEN). Recent studies have demonstrated that lenalidomide can enhance antitumor functions of CAR modified T cells (Otahal et al., Oncoimmunology, 2015, 5(4): e1115940). Some examples of anti-tumor antibodies include tocilizumab, siltuximab.

Other agents may be used in combination with compositions of the invention may also include, but not limited to, agents that affect the upregulation of cell surface receptors and their ligands such as Fas/Fas ligand, DR4 or DR5/TRAIL and GAP junctions, cytostatic and differentiation agents, inhibitors of cell adhesion such as focal adhesion kinase (FAKs) inhibitors and Lovastatin, or agents that increase the sensitivity of the hyper proliferative cells to apoptotic inducers such as the antibody C225.

The combinations may include administering the compositions of the invention and other agents at the same time or separately. Alternatively, the present immunotherapy may precede or follow the other agent/therapy by intervals ranging from minutes, days, weeks to months.

In some embodiments, CAR-T cells of the invention may be co-administered with retinoids to eradicate myeloid derived suppressor cells. Myeloid-derived suppressor cells (MDSCs) are a heterogeneous population of early myeloid progenitors, immature granulocytes, macrophages, and dendritic cells at different stages of differentiation. MDSCs have the capacity to suppress both the cytotoxic activities of natural killer (NK) and NKT cells, and the adaptive immune response mediated by CD4+ and CD8+ T cells. Long A H et al. (2016) Cancer Immunol Res.; 4(10):869-880 have described the co-treatment of CARs with all trans retinoic acid (ATRA) for the successful treatment of solid tumors (the contents of which are incorporated by reference in its entirety).

Adjuvant therapy as used herein refers to the treatment that is given in addition to primary therapy to kill any cancer cells, even if the cancer is undetectable by standard laboratory tests. Experimental data have demonstrated that the lymphocyte depletion induced by cytotoxic regimens for the treatment of cancer could contribute to relapse. Relapse to cancer immunotherapy may be minimized by adjuvant immunotherapy. In some embodiments, adjuvant therapy may include the co-administration of recombinant human Interleukin2 in conjunction with dendritic cells pulsed with peptides derived from tumor cells. In some embodiments, dendritic cells pulsed with autologous tumor cell lysate and keyhole limpet hemocyanin (KLH). Immune cells may be further depleted of CD25 positive T cells. Interleukin 7 may also be co-administered as immunotherapy. In some embodiments, the risk of reinfusing donor-derived tumor cells may be purged with monoclonal antibody 8H9, which interacts with tumor cell surface antigens. Any of the adjuvant therapy methods taught in Merchant et al. (2016), Clin Cancer Res. 1; 22(13):3182-91 may be utilized (the contents of which are incorporated by reference in their entirety).

In some embodiments, compositions of the invention can be combined with CXCR2 inhibitors or anti-CXCR2 antibodies. Highfill S L et al. (2014) found that CXCR2 positive MDSC cells limit the efficacy of immunotherapy by mediating local immunosuppression (Highfill S L, et al. Sci Transl Med. 2014 May 21; 6(237):237ra67; the contents of which are incorporated herein by reference in its entirety).

4. Diseases

Provided in the present invention is a method of reducing a tumor volume or burden in a subject in need, the method comprising introducing into the subject a composition of the invention.

The present invention also provides methods for treating a cancer in a subject, comprising administering to the subject an effective amount of an immune effector cell genetically modified to express at least one effector module of the invention.

Cancer

Various cancers may be treated with pharmaceutical compositions, biocircuits, biocircuit components, effector modules including their SREs or payloads of the present invention. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the compositions of the present invention include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphoma/leukemia, squamous cell carcinoma, small cell carcinoma, large cell undifferentiated carcinomas, basal cell carcinoma and sinonasal undifferentiated carcinoma.

Types of carcinomas which may be treated with the compositions of the present invention include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the carcinoma which may be treated may be Acute granulocytic leukemia, Acute lymphocytic leukemia, Acute myelogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stem glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epithelioid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Germ cell tumor, Glioblastoma multiforme, Glioma, Hairy cell leukemia, Head and neck cancer, Hemangioendothelioma, Hodgkin lymphoma, Hodgkin's disease, Hodgkin's lymphoma, Hypopharyngeal cancer, Infiltrating ductal carcinoma, Infiltrating lobular carcinoma, Inflammatory breast cancer, Intestinal Cancer, Intrahepatic bile duct cancer, Invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullary carcinoma, Medulloblastoma, Melanoma, Meningioma, Merkel cell carcinoma, Mesenchymal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple myeloma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soft tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

In some embodiments, the CARs of the present invention may be a CAR useful in the treatment of multiple myeloma such as a CS1 CAR, a CD38 CAR, a CD138 CAR, and a BCMA CAR. In some embodiments, the CARs of the present invention may be a CAR useful in the treatment of acute myeloid leukemia such as a CD33 CAR, a CD123 CAR, and a CLL1 CAR. In some embodiments, the CARs of the present invention may be a CAR useful in the treatment of T cell leukemia such as a CD5 CAR, and a CD7 CAR. In some embodiments, the CARs of the present invention may be a CAR useful in the treatment of solid tumors such a mesothelin CAR, a GD2 CAR, a GPC3 CAR, a Her2 CAR, an EGFR CAR, a Muc1 CAR, an EpCAM CAR, a PD-L1 CAR, a CEA CAR, a Muc16 CAR, a CD133 CAR, a CD171 CAR, a CD70 CAR, a CLD18 CAR, a cMET CAR, a EphA2 CAR, a FAP CAR, a Folate Receptor CAR, an IL13Ra2 CAR, an MG7 CAR, a PSMA CAR, a ROR1 CAR, and a VEGFR2 CAR.

Infectious Diseases

In some embodiment, biocircuits of the invention may be used for the treatment of infectious diseases. Biocircuits of the invention may be introduced in cells suitable for adoptive cell transfer such as macrophages, dendritic cells, natural killer cells, and or T cells. Infectious diseases treated by the biocircuits of the invention may be diseases caused by viruses, bacteria, fungi, and/or parasites. IL15-IL15Ra payloads of the invention may be used to increase immune cell proliferation and/or persistence of the immune cells useful in treating infectious diseases.

"Infection diseases" herein refer to diseases caused by any pathogen or agent that infects mammalian cells, preferably human cells and causes a disease condition. Examples thereof include bacteria, yeast, fungi, protozoans, *mycoplasma*, viruses, prions, and parasites. Examples include those involved in (a) viral diseases such as, for example, diseases resulting from infection by an adenovirus, a herpesvirus (e.g., HSV-I, HSV-II, CMV, or VZV), a poxvirus (e-g-, an orthopoxvirus such as variola or vaccinia, or molluscum contagiosum), a picornavirus (e.g., rhinovirus or enterovirus), an orthomyxovirus (e.g., influenzavirus), a paramyxovirus (e.g., parainfluenza virus, mumps virus, measles virus, and respiratory syncytial virus (RSV)), a coronavirus (e.g., SARS), a papovavirus (e.g., papillomaviruses, such as those that cause genital warts, common warts, or plantar warts), a hepadnavirus (e.g., hepatitis B virus), a flavivirus (e.g., hepatitis C virus or Dengue virus), or a retrovirus (e.g., a lentivirus such as HIV); (b) bacterial diseases such as, for example, diseases resulting from infection by bacteria of, for example, the genus *Escherichia, Enterobacter, Salmonella, Staphylococcus, Shigella, Listeria, Aerobacter, Helicobacter, Klebsiella, Proteus, Pseudomonas, Streptococcus, Chlamydia, Mycoplasma, Pneumococcus, Neisseria, Clostridium, Bacillus, Corynebacterium, Mycobacterium, Campylobacter, Vibrio, Serratia, Providencia, Chromobacterium, Brucella, Yersinia, Haemophilus,* or *Bordetella*; (c) other infectious diseases, such *chlamydia*, fungal diseases including but not limited to candidiasis, aspergillosis, histoplasmosis, cryptococcal meningitis, parasitic diseases including but not limited to malaria, *Pneumocystis* carnii pneumonia, leishmaniasis, cryptosporidiosis, toxoplasmosis, and trypanosome infection and prions that cause human disease such as Creutzfeldt-Jakob Disease (CJD), variant Creutzfeldt-Jakob Disease (vCJD), Gerstmann-Straiissler-Scheinker syndrome, Fatal Familial Insomnia and kuru.

5. Microbiome

Alterations in the composition of the microbiome may impact the action of anti-cancer therapies. A diverse community of symbiotic, commensal and pathogenic microorganisms exist in all environmentally exposed sites in the body and is herein referred to as the "Microbiome." Environmentally exposed sites of the body that may be inhabited by a microbiome include the skin, nasopharynx, the oral cavity, respiratory tract, gastrointestinal tract, and the reproductive tract.

In some embodiments, microbiome native or engineered with immunotherapeutic agents may be used to improve the efficacy of the anti-cancer immunotherapies. Methods of using microbiome to improve responsive to immunotherapeutic agents have been described by Sivan et al (Sivan A., et al. Commensal *Bifidobacterium* promotes antitumor immunity and facilitates anti-PD-L1 efficacy. Science 2015; 350:1084-9; the contents of which are incorporated herein by reference in their entirety). In one embodiment, protein, RNA and/or other biomolecules derived from the microbiome may be used as a payload to influence the efficacy of the anti-cancer immunotherapies.

In some embodiments, microbiome native or engineered with immunotherapeutic agents may be used to improve the efficacy of the anti-cancer immunotherapies. Methods of using microbiome to improve responsive to immunothera-peutic agents have been described by Sivan et al. (Sivan A., et al. 2015. Science; 350:1084-9; the contents of which are incorporated herein by reference in their entirety). In other embodiments, the microorganisms may be delivered along with immunotherapeutic compositions of the present invention to improve the efficacy of immunotherapy.

6. Tools and Agents for Making Therapeutics

Provided in the present invention are tools and agents that may be used in generating immunotherapeutics for reducing a tumor volume or burden in a subject in need. A considerable number of variables are involved in producing a therapeutic agent, such as structure of the payload, type of cells, method of gene transfers, method and time of ex vivo expansion, pre-conditioning and the amount and type of tumor burden in the subject. Such parameters may be optimized using tools and agents described herein.

Provided in the present invention are tools and agents that may be used in generating immunotherapeutics for reducing a tumor volume/burden or enhancing immune cell persistence in a subject in need. A considerable number of variables are involved in producing a therapeutic agent, such as structure of the payload, type of cells, method of gene transfers, method and time of ex vivo expansion, pre-conditioning and the amount and type of tumor burden in the subject. Such parameters may be optimized using tools and agents described herein.

Cell Lines

The present disclosure provides a mammalian cell that has been genetically modified with the compositions of the invention. Suitable mammalian cells include primary cells and immortalized cell lines. Suitable mammalian cell lines include, but are not limited to Human embryonic kidney cell line 293, fibroblast cell line NIH 3T3, human colorectal carcinoma cell line HCT116, ovarian carcinoma cell line SKOV-3, immortalized T cell lines (e.g. Jurkat cells and SupT1 cells), lymphoma cell line Raji cells, NALM-6 cells, K562 cells, HeLa cells, PC12 cells, HL-60 cells, NK cell lines (e.g. NKL, NK92, NK962, and YTS), and the like. In some instances, the cell is not an immortalized cell line, but instead a cell obtained from an individual and is herein referred to as a primary cell. For example, the cell is a T lymphocyte obtained from an individual. Other examples include, but are not limited to cytotoxic cells, stem cells, peripheral blood mononuclear cells or progenitor cells obtained from an individual.

The present disclosure provides a mammalian cell that has been genetically modified with the compositions of the invention. Suitable mammalian cells include primary cells and immortalized cell lines. Suitable mammalian cell lines include, but are not limited to Human embryonic kidney cell line 293, fibroblast cell line NIH 3T3, human colorectal carcinoma cell line HCT116, ovarian carcinoma cell line SKOV-3, immortalized T cell lines Jurkat cells and SupT1 cells, lymphoma cell line Raji cells, NALM-6 cells, K562 cells, HeLa cells, PC12 cells, HL-60 cells, NK cell lines (e.g., NKL, NK92, NK962, and YTS), REH, SEM, KOPN8, Daudi, Raji, and the like. In some instances, the cell is not an immortalized cell line, but instead a cell obtained from an individual and is herein referred to as a primary cell. For example, the cell is a T lymphocyte obtained from an individual. Other examples include, but are not limited to cytotoxic cells, stem cells, peripheral blood mononuclear cells or progenitor cells obtained from an individual.

Tracking SREs, Biocircuits and Cell Lines

In some embodiments, it may be desirable to track the compositions of the invention or the cells modified by the compositions of the invention. Tracking may be achieved by using reporter moieties, which, as used herein, refers to any protein capable of creating a detectable signal, in response to an input. Examples include alkaline phosphatase, β-galactosidase, chloramphenicol acetyltransferase, β-glucuronidase, peroxidase, β-lactamase, catalytic antibodies, bioluminescent proteins e.g. luciferase, and fluorescent proteins such as Green fluorescent protein (GFP).

In some embodiments, it may be desirable to track the compositions of the invention or the cells modified by the compositions of the invention. Tracking may be achieved by using payloads such as reporter moieties, which, as used herein, refers to any protein capable of creating a detectable signal, in response to an input. Examples include alkaline phosphatase, β-galactosidase, chloramphenicol acetyltransferase, β-glucuronidase, peroxidase, β-lactamase, catalytic antibodies, bioluminescent proteins e.g. luciferase, and fluorescent proteins such as Green fluorescent protein (GFP).

Reporter moieties may be used to monitor the response of the DD upon addition of the ligand corresponding to the DD. In other instances, reporter moieties may be used to track cell survival, persistence, cell growth, and/or localization in vitro, in vivo, or ex vivo.

In some embodiments, the preferred reporter moiety may be luciferase proteins. In one embodiment, the reporter moiety is the *Renilla* luciferase (SEQ ID NO. 6373, encoded by nucleic acid sequence of SEQ ID NO. 6374), or a firefly luciferase (SEQ ID NO. 6375, encoded by nucleic acid sequence of SEQ ID NO. 6376).

In some embodiments, the preferred reporter moiety may be luciferase proteins. In one embodiment, the reporter moiety is the *Renilla* luciferase, or a firefly luciferase. Table 43 provides the sequences of the reporter moieties. The amino acid sequences in Table 43 may comprise a stop codon which is denoted in the table with a "*" at the end of the amino acid sequence

TABLE 43

DD-luciferase constructs

| Description | Amino acid sequence | Amino Acid SEQ ID NO. | Nucleic Acid SEQ ID NO. |
|---|---|---|---|
| Linker | EF | — | 2716 |
| Linker | SG | — | 2717 |
| Renilla luciferase | MTSKVYDPEQRKRMITGPQWWARCKQMNVLDSFINYYDSEKHAEN AVIFLHGNAASSYLWRHVVPHIEPVARCIIPDLIGMGKSGKSGNG SYRLLDHYKYLTAWFELLNLPKKIIFVGHDWGACLAFHYSYEHQD KIKAIVHAESVVDVIESWDEWPDIEEDIALIKSEEGEKMVLENNF FVETMLPSKIMRKLEPEEFAAYLEPFKEKGEVRRPTLSWPREIPL VKGGKPDVVQIVRNYNAYLRASDDLPKMFIESDPGFFSNAIVEGA KKFPNTEFVKVKGLHFSQEDAPDEMGKYIKSFVERVLKNEQ | 3069 | 6377 |
| Firefly Luciferase | MEDAKNIKKGPAPFYPLEDGTAGEQLHKAMKRYALVPGTIAFTDA HIEVDITYAEYFEMSVRLAEAMKRYGLNTNHRIVVCSENSLQFFM PVLGALFIGVAVAPANDIYNERELLNSMGISQPTVVFVSKKGLQK ILNVQKKLPIIQKIIIMDSKTDYQGFQSMYTFVTSHLPPGFNEYD FVPESFDRDKTIALIMNSSGSTGLPKGVALPHRTACVRFSHARDP IFGNQIIPDTAILSVVPFHHGFGMTTLGYLICGFRVVLMYRFEE ELFLRSLQDYKIQSALLVPTLFSFFAKSTLIDKYDLSNLHEIASG GAPLSKEVGEAVAKRFHLPGIRQGYGLTETTSAILITPEGDDKPG AVGKVVPFFEAKVVDLDTGKTLGVNQRGELCVRGPMIMSGYVNNP EATNALIDKDGWLHSGDIAYWDEDEHFFIVDRLKSLIKYKGYQVA PAELESILLQHPNIFDAGVAGLPDDDAGELPAAVVVLEHGKTMTE KEIVDYVASQVTTAKKLRGGVVFVDEVPKGLTGKLDARKIREILI KAKKGGKSKL | 3070 | 6378 |
| FKBP (F36V, L106P) | GVQVETISPGDGRTFPKRGQTCVVHYTGMLEDGKKVDSSRDRNKP FKFMLGKQEVIRGWEEGVAQMSVGQRAKLTISPDYAYGATGHPGI IPPHATLVFDVELLKPE | 2778 | 6379-6384 |
| FKBP (E31G, F36V, R71G, K105E) | GVQVETISPGDGRTFPKRGQTCVVHYTGMLGDGKKVDSSRDRNKP FKFMLGKQEVIRGWEEGVAQMSVGQGAKLTISPDYAYGATGHPGI IPPHATLVFDVELLELE | 2775 | 6385-6392 |
| ecDHFR (R12Y, Y100I) | MISLIAALAVDYVIGMENAMPWNLPADLAWFKRNTLNKPVIMGRH TWESIGRPLPGRKNIILSSQPGTDDRVTWVKSVDEAIAACGDVPE IMVIGGGRVIEQFLPKAQKLYLTHIDAEVEGDTHFPDYEPDDWES VFSEFHDADAQNSHSYCFEILERR | 2979 | 6393 |
| OT-Rluc-001 (Renilla Luc-stop) | MTSKVYDPEQRKRMITGPQWWARCKQMNVLDSFINYYDSEKHAEN AVIFLHGNAASSYLWRHVVPHIEPVARCIIPDLIGMGKSGKSGNG SYRLLDHYKYLTAWFELLNLPKKIIFVGHDWGACLAFHYSYEHQD KIKAIVHAESVVDVIESWDEWPDIEEDIALIKSEEGEKMVLENNF FVETMLPSKIMRKLEPEEFAAYLEPFKEKGEVRRPTLSWPREIPL VKGGKPDVVQIVRNYNAYLRASDDLPKMFIESDPGFFSNAIVEGA KKFPNTEFVKVKGLHFSQEDAPDEMGKYIKSFVERVLKNEQ* | 3071 | 6394 |

TABLE 43-continued

DD-luciferase constructs

| Description | Amino acid sequence | Amino Acid SEQ ID NO. | Nucleic Acid SEQ ID NO. |
|---|---|---|---|
| OT-Flue-002 (Met-FKBP (F36V, L106P)- Linker (EF)- Firefly Luc- stop) | MGVQVETISPGDGRTFPKRGQTCVVHYTGMLEDGKKVDSSRDRNK PFKFMLGKQEVIRGWEEGVAQMSVGQRAKLTISPDYAYGATGHPG IIPPHATLVFDVELLKPEEFMEDAKNIKKGPAPFYPLEDGTAGEQ LHKAMKRYALVPGTIAFTDAHIEVDITYAEYFEMSVRLAEAMKRY GLNTNHRIVVCSENSLQFFMPVLGALFIGVAVAPANDIYNERELL NSMGISQPTVVFVSKKGLQKILNVQKKLPIIQKIIIMDSKTDYQG FQSMYTFVTSHLPPGFNEYDFVPESFDRDKTIALIMNSSGSTGLP KGVALPHRTACVRFSHARDPIFGNQIIPDTAILSVVPFHHGFGMF TTLGYLICGFRVVLMYRFEEELFLRSLQDYKIQSALLVPTLFSFF AKSTLIDKYDLSNLHEIASGGAPLSKEVGEAVAKRFHLPGIRQGY GLTETTSAILITPEGDDKPGAVGKVVPFFEAKVVDLDTGKTLGVN QRGELCVRGPMIMSGYVNNPEATNALIDKDGWLHSGDIAYWDEDE HFFIVDRLKSLIKYKGYQVAPAELESILLQHPNIFDAGVAGLPDD DAGELPAAVVVLEHGKTMTEKEIVDYVASQVTTAKKLRGGVVFVD EVPKGLTGKLDARKIREILIKAKKGGKSKL* | 3072 | 6395 |
| OT-Rluc-003 (Met-FKBP (F36V, L106P)- Linker (SG)- Amino acid 2-311 of Renilla Luciferase- stop) | MGVQVETISPGDGRTFPKRGQTCVVHYTGMLEDGKKVDSSRDRNK PFKFMLGKQEVIRGWEEGVAQMSVGQRAKLTISPDYAYGATGHPG IIPPHATLVFDVELLKPESGTSKVYDPEQRKRMITGPQWWARCKQ MNVLDSFINYYDSEKHAENAVIFLHGNAASSYLWRHVVPHIEPVA RCIIPDLIGMGKSGKSGNGSYRLLDHYKYLTAWFELLNLPKKIIF VGHDWGACLAFHYSYEHQDKIKAIVHAESVVDVIESWDEWPDIEE DIALIKSEEGEKMVLENNFFVETMLPSKIMRKLEPEEFAAYLEPF KEKGEVRRPTLSWPREIPLVKGGKPDVVQIVRNYNAYLRASDDLP KMFIESDPGFFSNAIVEGAKKFPNTEFVKVKGLHFSQEDAPDEMG KYIKSFVERVLKNEQ* | 3073 | 6396 |
| OT-Rluc-004 (ecDHFR (R12Y, Y100I)- Linker (SG)- Amino acid 2-311 of Renilla Luciferase- stop) | MISLIAALAVDYVIGMENAMPWNLPADLAWFKRNTLNKPVIMGRH TWESIGRPLPGRKNIILSSQPGTDDRVTWVKSVDEAIAACGDVPE IMVIGGGRVIEQFLPKAQKLYLTHIDAEVEGDTHFPDYEPDDWES VFSEFHDADAQNSHSYCFEILERRSGTSKVYDPEQRKRMITGPQW WARCKQMNVLDSFINYYDSEKHAENAVIFLHGNAASSYLWRHVVP HIEPVARCIIPDLIGMGKSGKSGNGSYRLLDHYKYLTAWFELLNL PKKHFVGHDWGACLAFHYSYEHQDKIKAIVHAESVVDVIESWDEW PDIEEDIALIKSEEGEKMVLENNFFVETMLPSKIMRKLEPEEFAA YLEPFKEKGEVRRPTLSWPREIPLVKGGKPDVVQIVRNYNAYLRA SDDLPKMFIESDPGFFSNAIVEGAKKFPNTEFVKVKGLHFSQEDA PDEMGKYIKSFVERVLKNEQ* | 3074 | 6397 |
| OT-Rluc-005 (Renilla Luc- Linker (SG) - FKBP (E31G, F36V, R71G, K105E)-stop) | MTSKVYDPEQRKRMITGPQWWARCKQMNVLDSFINYYDSEKHAEN AVIFLHGNAASSYLWRHVVPHIEPVARCIIPDLIGMGKSGKSGNG SYRLLDHYKYLTAWFELLNLPKKIIFVGHDWGACLAFHYSYEHQD KIKAIVHAESVVDVIESWDEWPDIEEDIALIKSEEGEKMVLENNF FVETMLPSKIMRKLEPEEFAAYLEPFKEKGEVRRPTLSWPREIPL VKGGKPDVVQIVRNYNAYLRASDDLPKMFIESDPGFFSNAIVEGA KKFPNTEFVKVKGLHFSQEDAPDEMGKYIKSFVERVLKNEQSGGV QVETISPGDGRTFPKRGQTCVVHYTGMLGDGKKVDSSRDRNKPFK FMLGKQEVIRGWEEGVAQMSVGQGAKLTISPDYAYGATGHPGIIP PHATLVFDVELLELE* | 3075 | 6398 |
| OT-Rluc-006 (Renilla Luc- Linker (SG)- ecDHFR (Amino acid 2-159 of WT) (R12Y, Y100I)-stop) | MTSKVYDPEQRKRMITGPQWWARCKQMNVLDSFINYYDSEKHAEN AVIFLHGNAASSYLWRHVVPHIEPVARCIIPDLIGMGKSGKSGNG SYRLLDHYKYLTAWFELLNLPKKIIFVGHDWGACLAFHYSYEHQD KIKAIVHAESVVDVIESWDEWPDIEEDIALIKSEEGEKMVLENNF FVETMLPSKIMRKLEPEEFAAYLEPFKEKGEVRRPTLSWPREIPL VKGGKPDVVQIVRNYNAYLRASDDLPKMFIESDPGFFSNAIVEGA KKFPNTEFVKVKGLHFSQEDAPDEMGKYIKSFVERVLKNEQSGIS LIAALAVDYVIGMENAMPWNLPADLAWFKRNTLNKPVIMGRHTWE SIGRPLPGRKNIILSSQPGTDDRVTWVKSVDEAIAACGDVPEIMV IGGGRVIEQFLPKAQKLYLTHIDAEVEGDTHFPDYEPDDWESVFS EFFIDADAQNSHSYCFEILERR* | 3076 | 6399 |

Animal Models

The utility and efficacy of the compositions of the present invention may be tested in vivo animal models, preferably mouse models. Mouse models used to may be syngeneic mouse models wherein mouse cells are modified with compositions of the invention and tested in mice of the same genetic background. Examples include pMEL-1 and 4T1 mouse models. Alternatively, xenograft models where human cells such as tumor cells and immune cells are introduced into immunodeficient mice may also be utilized in such studies. Immunodeficient mice used may be CByJ.Cg-Foxn1$^{nu}$/J, B6; 129S7-Rag1$^{tm1Mom}$/J, B6.129S7-Rag1$^{tm1Mom}$/J, B6. CB17-Prkdc$^{scid}$/SzJ, NOD. 129S7(B6)-Rag1$^{tm1Mom}$/J, NOD.Cg-Rag1$^{tm1Mom}$Prf1$^{tm1Sd}$z/Sz, NOD.CB17-Prkdc$^{scid}$/SzJ, NOD.Cg-Prkdc$^{scid}$B2m$^{tm1Unc}$/J, NOD-scid IL2Rg$^{null}$, Nude (nu) mice, SCID mice, NOD mice, RAG1/RAG2 mice, NOD-Scid mice, IL2rgnull mice, b2mnull mice, NOD-scid IL2rγnull mice, NOD-scid-B2mnull mice, beige mouse, and HLA transgenic mice.

Cellular Assays

In some embodiments, the effectiveness of the compositions of the inventions as immunotherapeutic agents may be evaluated using cellular assays. Levels of expression and/or identity of the compositions of the invention may be determined according to any methods known in the art for identifying proteins and/or quantitating proteins levels. In some embodiments, such methods may include Western Blotting, flow cytometry, and immunoassays.

Provided herein are methods for functionally characterizing cells expressing SRE, biocircuits and compositions of the invention. In some embodiments, functional characterization is carried out in primary immune cells or immortalized immune cell lines and may be determined by expression of cell surface markers. Examples of cell surface markers for T cells include, but are not limited to, CD3, CD4, CD8, CD 14, CD20, CD11b, CD16, CD45 and HLA-DR, CD 69, CD28, CD44, IFNgamma. Markers for T cell exhaustion include PD1, TIM3, BTLA, CD160, 2B4, CD39, and LAG3. Examples of cell surface markers for antigen presenting cells include, but are not limited to, MHC class I, MHC Class II, CD40, CD45, B7-1, B7-2, IFN-γ receptor and IL2 receptor, ICAM-1 and/or Fcγ receptor. Examples of cell surface markers for dendritic cells include, but are not limited to, MHC class I, MHC Class II, B7-2, CD18, CD29, CD31, CD43, CD44, CD45, CD54, CD58, CD83, CD86, CMRF-44, CMRF-56, DCIR and/or Dectin-1 and the like; while in some cases also having the absence of CD2, CD3, CD4, CD8, CD14, CD15, CD16, CD19, CD20, CD56, and/or CD57. Examples of cell surface markers for NK cells include, but are not limited to, CCL3, CCL4, CCL5, CCR4, CXCR4, CXCR3, NKG2D, CD71, CD69, CCR5, Phospho JAK/STAT, phospho ERK, phospho p38/MAPK, phospho AKT, phospho STAT3, Granulysin, Granzyme B, Granzyme K, IL10, IL22, IFNg, LAP, Perforin, and TNFa.

Provided herein are methods for functionally characterizing cells expressing SRE, biocircuits and compositions of the invention. In some embodiments, functional characterization is carried out in primary immune cells or immortalized immune cell lines and may be determined by expression of cell surface markers. Examples of cell surface markers for T cells include, but are not limited to, CD3, CD4, CD8, CD14, CD20, CD11b, CD16, CD45 and HLA-DR, CD 69, CD28, CD44, IFNgamma, PD1, TIM3 and LAG3. Examples of cell surface markers for antigen presenting cells include, but are not limited to, MHC class I, MHC Class II, CD40, CD45, B7-1, B7-2, IFN-γ receptor and IL2 receptor, ICAM-1 and/or Fcγ receptor. Examples of cell surface markers for dendritic cells include, but are not limited to, MHC class I, MHC Class II, B7-2, CD18, CD29, CD31, CD43, CD44, CD45, CD54, CD58, CD83, CD86, CMRF-44, CMRF-56, DCIR and/or Dectin-1 and the like; while in some cases also having the absence of CD2, CD3, CD4, CD8, CD14, CD15, CD16, CD19, CD20, CD56, and/or CD57. Examples of cell surface markers for NK cells include, but are not limited to, CCL3, CCL4, CCL5, CCR4, CXCR4, CXCR3, NKG2D, CD71, CD69, CCR5, Phospho JAK/STAT, phospho ERK, phospho p38/MAPK, phospho AKT, phospho STAT3, Granulysin, Granzyme B, Granzyme K, IL10, IL22, IFNg, LAP, Perforin, and TNFa.

V. Delivery Modalities and/or Vectors

Vectors

The present invention also provides vectors that package polynucleotides of the invention encoding biocircuits, effector modules, SREs (DDs) and payload constructs, and combinations thereof. Vectors of the present invention may also be used to deliver the packaged polynucleotides to a cell, a local tissue site or a subject. These vectors may be of any kind, including DNA vectors, RNA vectors, plasmids, viral vectors and particles. Viral vector technology is well known and described in Sambrook et al. (2001, Molecular Cloning: A Laboratory Manual, Cold Spring Harbor Laboratory, New York). Viruses, which are useful as vectors include, but are not limited to lentiviral vectors, adenoviral vectors, adeno-associated viral (AAV) vectors, herpes simplex viral vectors, retroviral vectors, oncolytic viruses, and the like.

In general, vectors contain an origin of replication functional in at least one organism, a promoter sequence and convenient restriction endonuclease site, and one or more selectable markers e.g. a drug resistance gene.

As used herein a promoter is defined as a DNA sequence recognized by transcription machinery of the cell, required to initiate specific transcription of the polynucleotide sequence of the present invention. Vectors can comprise native or non-native promoters operably linked to the polynucleotides of the invention. The promoters selected may be strong, weak, constitutive, inducible, tissue specific, development stage-specific, and/or organism specific. One example of a suitable promoter is the immediate early cytomegalovirus (CMV) promoter sequence. This promoter sequence is a strong constitutive promoter sequence capable of driving high levels of expression of polynucleotide sequence that is operatively linked to it. Another example of a preferred promoter is Elongation Growth Factor-1. Alpha (EF-1. alpha). Other constitutive promoters may also be used, including, but not limited to simian virus 40 (SV40), mouse mammary tumor virus (MMTV), human immunodeficiency virus (HIV), long terminal repeat (LTR), promoter, an avian leukemia virus promoter, an Epstein-Barr virus immediate early promoter, a Rous sarcoma virus promoter as well as human gene promoters including, but not limited to the phosphoglycerate kinase (PGK) promoter, actin promoter, the myosin promoter, the hemoglobin promoter, the Ubiquitin C (Ubc) promoter, the human U6 small nuclear protein promoter and the creatine kinase promoter. In some instances, inducible promoters such as but not limited to metallothionine promoter, glucocorticoid promoter, a progesterone promoter, and a tetracycline promoter may be used. In some embodiments, the promoter may be selected from the SEQ ID NO.: 6400-6402. In some embodiments, the promoter may be selected from the SEQ. ID NO. 6403-6405 and 6406. In some embodiments, the promoter may be selected from the SEQ ID NO. 6407-6410. In some embodiments, the promoter may be selected from the SEQ ID NO. 3095-3097, SEQ ID NO. 3098.

In some embodiments, the optimal promoter may be selected based on its ability to achieve minimal expression of the SREs and payloads of the invention in the absence of the ligand and detectable expression in the presence of the ligand.

Additional promoter elements e.g. enhancers may be used to regulate the frequency of transcriptional initiation. Such regions may be located 10-100 base pairs upstream or downstream of the start site. In some instances, two or more promoter elements may be used to cooperatively or independently activate transcription.

Suitable vectors include those designed for propagation and expansion or for expression or both, such as plasmids and viruses. The vector can be selected from the group consisting of the pUC series (Fermentas Life Sciences, Glen Burnie, Md.), the pBluescript series (Stratagene, La Jolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGT10, λGT11, λZapII (Stratagene), λEMBL4, and λNM1149, also can be used. Examples of plant expression vectors include pBI01, pBI101.2, pBI101.3, pBI121 and pBIN19 (Clontech). Examples of animal expression vectors include pEUK-C1, pMAM, and pMAMneo (Clontech). The recombinant expression vector may be a viral vector, e.g., a retroviral vector or a lenti viral vector. In some embodiments, the vector can be a transposon. Any of the vectors disclosed in the International Patent Publication WO2014065961, may be useful in the present invention (the contents of which are incorporated herein by reference in their entirety).

In some embodiments, the recombinant expression vector may comprise regulatory sequences, such as transcription and translation initiation and termination codons, which are specific to the type of host cell into which the vector is to be introduced.

1. Lentiviral Vectors

In some embodiments, lentiviral vectors/particles may be used as vehicles and delivery modalities. Lentiviruses are subgroup of the Retroviridae family of viruses, named because reverse transcription of viral RNA genomes to DNA is required before integration into the host genome. As such, the most important features of lentiviral vehicles/particles are the integration of their genetic material into the genome of a target/host cell. Some examples of lentivirus include the Human Immunodeficiency Viruses: HIV-1 and HIV-2, the Simian Immunodeficiency Virus (SIV), feline immunodeficiency virus (FIV), bovine immunodeficiency virus (BIV), Jembrana Disease Virus (JDV), equine infectious anemia virus (EIAV), equine infectious anemia virus, visna-maedi and caprine arthritis encephalitis virus (CAEV).

Typically, lentiviral particles making up the gene delivery vehicle are replication defective on their own (also referred to as "self-inactivating"). Lentiviruses are able to infect both dividing and non-dividing cells by virtue of the entry mechanism through the intact host nuclear envelope (Naldini L et al., *Curr. Opin. Biotechnol,* 1998, 9: 457-463). Recombinant lentiviral vehicles/particles have been generated by multiply attenuating the HIV virulence genes, for example, the genes Env, Vif, Vpr, Vpu, Nef and Tat are deleted making the vector biologically safe. Correspondingly, lentiviral vehicles, for example, derived from HIV-1/HIV-2 can mediate the efficient delivery, integration and long-term expression of transgenes into non-dividing cells. As used herein, the term "recombinant" refers to a vector or other nucleic acid containing both lentiviral sequences and non-lentiviral retroviral sequences.

Lentiviral particles may be generated by co-expressing the virus packaging elements and the vector genome itself in a producer cell such as human HEK293T cells. These elements are usually provided in three (in second generation lentiviral systems) or four separate plasmids (in third generation lentiviral systems). The producer cells are co-transfected with plasmids that encode lentiviral components including the core (i.e. structural proteins) and enzymatic components of the virus, and the envelope protein(s) (referred to as the packaging systems), and a plasmid that encodes the genome including a foreign transgene, to be transferred to the target cell, the vehicle itself (also referred to as the transfer vector). In general, the plasmids or vectors are included in a producer cell line. The plasmids/vectors are introduced via transfection, transduction or infection into the producer cell line. Methods for transfection, transduction or infection are well known by those of skill in the art. As non-limiting example, the packaging and transfer constructs can be introduced into producer cell lines by calcium phosphate transfection, lipofection or electroporation, generally together with a dominant selectable marker, such as neo, DHFR, Gln synthetase or ADA, followed by selection in the presence of the appropriate drug and isolation of clones.

The producer cell produces recombinant viral particles that contain the foreign gene, for example, the effector module of the present invention. The recombinant viral particles are recovered from the culture media and titrated by standard methods used by those of skill in the art. The recombinant lentiviral vehicles can be used to infect target cells.

Cells that can be used to produce high-titer lentiviral particles may include, but are not limited to, HEK293T cells, 293G cells, STAR cells (Relander et al., *Mol. Ther.,* 2005, 11: 452-459), FreeStyle™ 293 Expression System (ThermoFisher, Waltham, Mass.), and other HEK293T-based producer cell lines (e.g., Stewart et al., *Hum Gene Ther.* 2011, 22(3):357-369; Lee et al., *Biotechnol Bioeng,* 2012, 10996): 1551-1560; Throm et al., *Blood.* 2009, 113(21): 5104-5110; the contents of each of which are incorporated herein by reference in their entirety).

In some aspects, the envelope proteins may be heterologous envelop proteins from other viruses, such as the G protein of vesicular stomatitis virus (VSV G) or baculoviral gp64 envelop proteins. The VSV-G glycoprotein may especially be chosen among species classified in the vesiculovirus genus: *Carajas virus* (CJSV), *Chandipura virus* (CHPV), *Cocal virus* (COCV), *Isfahan virus* (ISFV), *Maraba virus* (MARAV), *Piry virus* (PIRYV), *Vesicular stomatitis Alagoas virus* (VSAV), *Vesicular stomatitis Indiana virus* (VSIV) and *Vesicular stomatitis New Jersey virus* (VSNJV) and/or stains provisionally classified in the vesiculovirus genus as *Grass carp rhabdovirus,* BeAn 157575 virus (BeAn 157575), *Boteke virus* (BTKV), *Calchaqui virus* (CQIV), *Eel virus American* (EVA), *Gray Lodge virus* (GLOV), *Jurona virus* (JURY), *Klamath virus* (KLAV), *Kwatta virus* (KWAV), *La Joya virus* (LJV), *Malpais Spring virus* (MSPV), *Mount Elgon bat virus* (MEBV), *Perinet virus* (PERV), *Pike fry rhabdovirus* (PFRV), *Porton virus* (PORV), *Radi virus* (RADIV), *Spring viremia of carp virus* (SVCV), *Tupaia virus* (TUPV), *Ulcerative disease rhabdovirus* (UDRV) and *Yug Bogdanovac virus* (YBV). The gp64 or other baculoviral env protein can be derived from *Autographa californica* nucleopolyhedrovirus (AcMNPV), *Anagrapha falcifera* nuclear polyhedrosis virus, *Bombyx mori* nuclear polyhedrosis virus, *Choristoneura fumiferana* nucleopolyhedrovirus, *Orgyia pseudotsugata* single capsid nuclear polyhedrosis virus, *Epiphyas postvittana* nucleopolyhedrovirus, *Hyphantria cunea* nucleopolyhedrovirus, *Galleria mellonella* nuclear polyhedrosis virus, Dhori virus, Thogoto virus, *Antheraea pemyi* nucleopolyhedrovirus or Batken virus.

Additional elements provided in lentiviral particles may comprise retroviral LTR (long-terminal repeat) at either 5' or 3' terminus, a retroviral export element, optionally a lentiviral reverse response element (RRE), a promoter or active portion thereof, and a locus control region (LCR) or active portion thereof. Other elements include central polypurine tract (cPPT) sequence to improve transduction efficiency in non-dividing cells, Woodchuck Hepatitis Virus (WHP) Post-transcriptional Regulatory Element (WPRE) which enhances the expression of the transgene, and increases titer. The effector module is linked to the vector.

Methods for generating recombinant lentiviral particles are discussed in the art, for example, U.S. Pat. Nos. 8,846,385; 7,745,179; 7,629,153; 7,575,924; 7,179,903; and 6,808,905; the contents of each of which are incorporated herein by reference in their entirety.

Lentivirus vectors used may be selected from, but are not limited to pLVX, pLenti, pLenti6, pLJM1, FUGW, pWPXL, pWPI, pLenti CMV puro DEST, pLJM1-EGFP, pULTRA, pInducer20, pHIV-EGFP, pCW57.1, pTRPE, pELPS, pRRL, and pLionII.

Lentiviral vehicles known in the art may also be used (See, U.S. Pat. Nos. 9,260,725; 9,068,199; 9,023,646; 8,900,858; 8,748,169; 8,709,799; 8,420,104; 8,329,462; 8,076,106; 6,013,516; and 5,994,136; International Patent Publication NO.: WO2012079000; the contents of each of which are incorporated herein by reference in their entirety).

2. Retroviral Vectors (γ-Retroviral Vectors)

In some embodiments, retroviral vectors may be used to package and deliver the biocircuits, biocircuit components, effector modules, SREs or payload constructs of the present invention. Retroviral vectors (RVs) allow the permanent integration of a transgene in target cells. In addition to lentiviral vectors based on complex HIV-1/2, retroviral vectors based on simple gamma-retroviruses have been widely used to deliver therapeutic genes and demonstrated clinically as one of the most efficient and powerful gene delivery systems capable of transducing a broad range of cell types. Example species of Gamma retroviruses include the murine leukemia viruses (MLVs) and the feline leukemia viruses (FeLV).

In some embodiments, gamma-retroviral vectors derived from a mammalian gamma-retrovirus such as murine leukemia viruses (MLVs), are recombinant. The MLV families of gamma retroviruses include the ecotropic, amphotropic, xenotropic and polytropic subfamilies. Ecotropic viruses are able to infect only murine cells using mCAT-1 receptor. Examples of ecotropic viruses are Moloney MLV and AKV. Amphotropic viruses infect murine, human and other species through the Pit-2 receptor. One example of an amphotropic virus is the 4070A virus. Xenotropic and polytropic viruses utilize the same (Xpr1) receptor, but differ in their species tropism. Xenotropic viruses such as NZB-9-1 infect human and other species but not murine species, whereas polytropic viruses such as focus-forming viruses (MCF) infect murine, human and other species.

Gamma-retroviral vectors may be produced in packaging cells by co-transfecting the cells with several plasmids including one encoding the retroviral structural and enzymatic (gag-pol) polyprotein, one encoding the envelope (env) protein, and one encoding the vector mRNA comprising polynucleotide encoding the compositions of the present invention that is to be packaged in newly formed viral particles.

In some aspects, the recombinant gamma-retroviral vectors are pseudotyped with envelope proteins from other viruses. Envelope glycoproteins are incorporated in the outer lipid layer of the viral particles which can increase/alter the cell tropism. Exemplary envelop proteins include the gibbon ape leukemia virus envelope protein (GALV) or vesicular stomatitis virus G protein (VSV-G), or Simian endogenous retrovirus envelop protein, or Measles Virus H and F proteins, or Human immunodeficiency virus gp120 envelope protein, or cocal vesiculovirus envelop protein (See, e.g., U.S. application publication NO.: 2012/164118; the contents of which are incorporated herein by reference in its entirety). In other aspects, envelope glycoproteins may be genetically modified to incorporate targeting/binding ligands into gamma-retroviral vectors, binding ligands including, but not limited to, peptide ligands, single chain antibodies and growth factors (Waehler et al., Nat. Rev. Genet. 2007, 8(8):573-587; the contents of which are incorporated herein by reference in its entirety). These engineered glycoproteins can retarget vectors to cells expressing their corresponding target moieties. In other aspects, a "molecular bridge" may be introduced to direct vectors to specific cells. The molecular bridge has dual specificities: one end can recognize viral glycoproteins, and the other end can bind to the molecular determinant on the target cell. Such molecular bridges, for example ligand-receptor, avidin-biotin, and chemical conjugations, monoclonal antibodies and engineered fusogenic proteins, can direct the attachment of viral vectors to target cells for transduction (Yang et al., Biotechnol. Bioeng., 2008, 101(2): 357-368; and Maetzig et al., Viruses, 2011, 3, 677-713; the contents of each of which are incorporated herein by reference in their entirety).

In some embodiments, the recombinant gamma-retroviral vectors are self-inactivating (SIN) gammaretroviral vectors. The vectors are replication incompetent. SIN vectors may harbor a deletion within the 3' U3 region initially comprising enhancer/promoter activity. Furthermore, the 5' U3 region may be replaced with strong promoters (needed in the packaging cell line) derived from Cytomegalovirus or RSV, or an internal promoter of choice, and/or an enhancer element. The choice of the internal promoters may be made according to specific requirements of gene expression needed for a particular purpose of the invention.

In some embodiments, polynucleotides encoding the biocircuit, biocircuit components, effector module, SRE are inserted within the recombinant viral genome. The other components of the viral mRNA of a recombinant gamma-retroviral vector may be modified by insertion or removal of naturally occurring sequences (e.g., insertion of an IRES, insertion of a heterologous polynucleotide encoding a polypeptide or inhibitory nucleic acid of interest, shuffling of a more effective promoter from a different retrovirus or virus in place of the wild-type promoter and the like). In some examples, the recombinant gamma-retroviral vectors may comprise modified packaging signal, and/or primer binding site (PBS), and/or 5'-enhancer/promoter elements in the U3-region of the 5'-long terminal repeat (LTR), and/or 3'-SIN elements modified in the U3-region of the 3'-LTR. These modifications may increase the titers and the ability of infection.

Gamma retroviral vectors suitable for delivering biocircuit components, effector modules, SREs or payload constructs of the present invention may be selected from those disclosed in U.S. Pat. Nos. 8,828,718; 7,585,676; 7,351,585; U.S. application publication NO.: 2007/048285; PCT application publication NOs.: WO2010/113037; WO2014/121005; WO2015/056014; and EP Pat. NOs.: EP1757702; EP1757703 (the contents of each of which are incorporated herein by reference in their entirety).

3. Adeno-Associated Viral Vectors (AAV)

In some embodiments, polynucleotides of present invention may be packaged into recombinant adeno-associated viral (rAAV) vectors. Such vectors or viral particles may be designed to utilize any of the known serotype capsids or combinations of serotype capsids. The serotype capsids may include capsids from any identified AAV serotypes and variants thereof, for example, AAV1, AAV2, AAV2G9, AAV3, AAV4, AAV4-4, AAV5, AAV6, AAV7, AAV8, AAV9, AAV10, AAV11, AAV12 and AAVrh10.

In one embodiment, the AAV serotype may be or have a sequence as described in United States Publication No. US20030138772, herein incorporated by reference in its entirety, such as, but not limited to, AAV1 (SEQ ID NO: 6 and 64 of US20030138772), AAV2 (SEQ ID NO: 7 and 70 of US20030138772), AAV3 (SEQ ID NO: 8 and 71 of US20030138772), AAV4 (SEQ ID NO: 63 of US20030138772), AAV5 (SEQ ID NO: 114 of US20030138772), AAV6 (SEQ ID NO: 65 of US20030138772), AAV7 (SEQ ID NO: 1-3 of US20030138772), AAV8 (SEQ ID NO: 4 and 95 of US20030138772), AAV9 (SEQ ID NO: 5 and 100 of US20030138772), AAV10 (SEQ ID NO: 117 of US20030138772), AAV11 (SEQ ID NO: 118 of US20030138772), AAV12 (SEQ ID NO: 119 of US20030138772), AAVrh10 (amino acids 1 to 738 of SEQ ID NO: 81 of US20030138772) or variants thereof. Non-limiting examples of variants include SEQ ID NOs: 9, 27-45, 47-62, 66-69, 73-81, 84-94, 96, 97, 99, 101-113 of US20030138772, the contents of which are herein incorporated by reference in their entirety.

In one embodiment, the AAV serotype may have a sequence as described in Pulicherla et al. (*Molecular Therapy*, 2011, 19(6):1070-1078), U.S. Pat. Nos. 6,156,303; 7,198,951; U.S. Patent Publication NOs.: US2015/0159173 and US2014/0359799; and International Patent Publication NOs.: WO1998/011244, WO2005/033321 and WO2014/14422; the contents of each of which are incorporated herein by reference in their entirety.

AAV vectors include not only single stranded vectors but self-complementary AAV vectors (scAAVs). scAAV vectors contain DNA which anneals together to form double stranded vector genome. By skipping second strand synthesis, scAAVs allow for rapid expression in the cell.

The rAAV vectors may be manufactured by standard methods in the art such as by triple transfection, in sf9 insect cells or in suspension cell cultures of human cells such as HEK293 cells.

The biocircuits, biocircuit components, effector modules, SREs or payload constructs may be encoded in one or more viral genomes to be packaged in the AAV capsids taught herein.

Such vectors or viral genomes may also include, in addition to at least one or two ITRs (inverted terminal repeats), certain regulatory elements necessary for expression from the vector or viral genome. Such regulatory elements are well known in the art and include for example promoters, introns, spacers, stuffer sequences, and the like.

In some embodiments, more than one effector module or SRE (e.g. DD) may be encoded in a viral genome.

4. Oncolytic Viral Vector

In some embodiments, polynucleotides of present invention may be packaged into oncolytic viruses, such as vaccine viruses. Oncolytic vaccine viruses may include viral particles of a thymidine kinase (TK)-deficient, granulocyte macrophage (GM)-colony stimulating factor (CSF)-expressing, replication-competent vaccinia virus vector sufficient to induce oncolysis of cells in the tumor (e.g., U.S. Pat. No. 9,226,977; the contents of which are incorporated by reference in their entirety).

5. Messenger RNA (mRNA)

In some embodiments, the effector modules of the invention may be designed as a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Such mRNA molecules may have the structural components or features of any of those taught in International Application number PCT/US2013/030062, the contents of which are incorporated herein by reference in its entirety.

Polynucleotides of the invention may also be designed as taught in, for example, Ribostem Limited in United Kingdom patent application serial number 0316089.2 filed on Jul. 9, 2003 now abandoned, PCT application number PCT/GB2004/002981 filed on Jul. 9, 2004 published as WO2005005622, U.S. patent application national phase entry Ser. No. 10/563,897 filed on Jun. 8, 2006 published as US20060247195 now abandoned, and European patent application national phase entry serial number EP2004743322 filed on Jul. 9, 2004 published as EP1646714 now withdrawn; Novozymes, Inc. in PCT application number PCT/US2007/88060 filed on Dec. 19, 2007 published as WO2008140615, U.S. patent application national phase entry Ser. No. 12/520,072 filed on Jul. 2, 2009 published as US20100028943 and European patent application national phase entry serial number EP2007874376 filed on Jul. 7, 2009 published as EP2104739; University of Rochester in PCT application number PCT/US2006/46120 filed on Dec. 4, 2006 published as WO2007064952 and U.S. patent application Ser. No. 11/606,995 filed on Dec. 1, 2006 published as US20070141030; BioNTech AG in European patent application serial number EP2007024312 filed Dec. 14, 2007 now abandoned, PCT application number PCT/EP2008/01059 filed on Dec. 12, 2008 published as WO2009077134, European patent application national phase entry serial number EP2008861423 filed on Jun. 2, 2010 published as EP2240572, U.S. patent application national phase entry Ser. No. 12/735,060 filed Nov. 24, 2010 published as US20110065103, German patent application serial number DE 10 2005 046 490 filed Sep. 28, 2005, PCT application PCT/EP2006/0448 filed Sep. 28, 2006 published as WO2007036366, national phase European patent EP1934345 published Mar. 21, 2012 and national phase U.S. patent application Ser. No. 11/992,638 filed Aug. 14, 2009 published as 20100129877; Immune Disease Institute Inc. in U.S. patent application Ser. No. 13/088,009 filed Apr. 15, 2011 published as US20120046346 and PCT application PCT/US2011/32679 filed Apr. 15, 2011 published as WO20110130624; Shire Human Genetic Therapeutics in U.S. patent application Ser. No. 12/957,340 filed on Nov. 20, 2010 published as US20110244026; Sequitur Inc. in PCT application PCT/US1998/019492 filed on Sep. 18, 1998 published as WO1999014346; The Scripps Research Institute in PCT application number PCT/US2010/00567 filed on Feb. 24, 2010 published as WO2010098861, and U.S. patent application national phase entry Ser. No. 13/203,229 filed Nov. 3, 2011 published as US20120053333; Ludwig-Maximillians University in PCT application number PCT/EP2010/004681 filed on Jul. 30, 2010 published as WO2011012316; Cellscript Inc. in U.S. Pat. No. 8,039,214 filed Jun. 30, 2008 and granted Oct. 18, 2011, U.S. patent application Ser. No. 12/962,498 filed on Dec. 7, 2010 published as US20110143436, Ser. No. 12/962,468 filed on Dec. 7, 2010 published as US20110143397, Ser. No. 13/237, 451 filed on Sep. 20, 2011 published as US20120009649, and PCT applications PCT/US2010/59305 filed Dec. 7, 2010 published as WO2011071931 and PCT/US2010/59317 filed on Dec. 7, 2010 published as WO2011071936; The Trustees of the University of Pennsylvania in PCT application number PCT/US2006/32372 filed on Aug. 21, 2006 published as WO2007024708, and U.S. patent application national phase entry Ser. No. 11/990,646 filed on Mar. 27, 2009 published as US20090286852; Curevac GMBH in German patent application serial numbers DE10 2001 027 283.9 filed Jun. 5, 2001, DE10 2001 062 480.8 filed Dec. 19, 2001, and DE 20 2006 051 516 filed Oct. 31, 2006 all abandoned, European patent numbers EP1392341 granted Mar. 30, 2005 and EP1458410 granted Jan. 2, 2008, PCT application numbers PCT/EP2002/06180 filed Jun. 5, 2002 published as WO2002098443, PCT/EP2002/14577 filed on Dec. 19, 2002 published as WO2003051401, PCT/EP2007/09469 filed on Dec. 31, 2007 published as WO2008052770, PCT/EP2008/03033 filed on Apr. 16, 2008 published as WO2009127230, PCT/EP2006/004784 filed on May 19, 2005 published as WO2006122828, PCT/EP2008/00081 filed on Jan. 9, 2007 published as WO2008083949, and U.S. patent application Ser. No. 10/729,830 filed on Dec. 5, 2003 published as US20050032730, Ser. No. 10/870,110 filed on Jun. 18, 2004 published as US20050059624, Ser. No. 11/914,945 filed on Jul. 7, 2008 published as US20080267873, Ser. No. 12/446,912 filed on Oct. 27, 2009 published as US2010047261 now abandoned, Ser. No. 12/522,214 filed on Jan. 4, 2010 published as US20100189729, Ser. No. 12/787,566 filed on May 26, 2010 published as US20110077287, Ser. No. 12/787,755 filed on May 26, 2010 published as US20100239608, Ser. No. 13/185,119 filed on Jul. 18, 2011 published as US20110269950, and Ser. No. 13/106,548 filed on May 12, 2011 published as US20110311472 all of which are herein incorporated by reference in their entirety.

In some embodiments, the effector modules may be designed as self-amplifying RNA. "Self-amplifying RNA" as used herein refers to RNA molecules that can replicate in the host resulting in the increase in the amount of the RNA and the protein encoded by the RNA. Such self-amplifying RNA may have structural features or components of any of those taught in International Patent Application Publication No. WO2011005799 (the contents of which are incorporated herein by reference in their entirety).

VI. Dosing, Delivery and Administrations

The compositions of the invention may be delivered to a cell or a subject through one or more routes and modalities. The viral vectors containing one or more effector modules, SREs, immunotherapeutic agents and other components described herein may be used to deliver them to a cell and/or a subject. Other modalities may also be used such as mRNAs, plasmids, and as recombinant proteins.

1. Delivery to Cells

In another aspect of the invention, polynucleotides encoding biocircuits, effector modules, SREs (e.g., DDs), payloads of interest (immunotherapeutic agents) and compositions of the invention and vectors comprising said polynucleotides may be introduced into cells such as immune effector cells.

In one aspect of the invention, polynucleotides encoding biocircuits, effector modules, SREs (e.g., DDs), payloads of interest (immunotherapeutic agents) and compositions of the invention, may be packaged into viral vectors or integrated into viral genomes allowing transient or stable expression of the polynucleotides. Preferable viral vectors are retroviral vectors including lentiviral vectors. In order to construct a retroviral vector, a polynucleotide molecule encoding a biocircuit, an effector module, a DD or a payload of interest (i.e. an immunotherapeutic agent) is inserted into the viral genome in the place of certain viral sequences to produce a virus that is replication-defective. The recombinant viral vector is then introduced into a packaging cell line containing the gag, pol, and env genes, but without the LTR and packaging components. The recombinant retroviral particles are secreted into the culture media, then collected, optionally concentrated, and used for gene transfer. Lentiviral vectors are especially preferred as they are capable of infecting both dividing and non-dividing cells.

Vectors may also be transferred to cells by non-viral methods by physical methods such as needles, electroporation, sonoporation, hyrdoporation; chemical carriers such as inorganic particles (e.g. calcium phosphate, silica, gold) and/or chemical methods. In some embodiments, synthetic or natural biodegradable agents may be used for delivery such as cationic lipids, lipid nano emulsions, nanoparticles, peptide based vectors, or polymer based vectors.

In some embodiments, the polypeptides of the invention may be delivered to the cell directly. In one embodiment, the polypeptides of the invention may be delivered using synthetic peptides comprising an endosomal leakage domain (ELD) fused to a cell penetration domain (CLD). The polypeptides of the invention are co introduced into the cell with the ELD-CLD-synthetic peptide. ELDs facilitate the escape of proteins that are trapped in the endosome, into the cytosol. Such domains are derived proteins of microbial and viral origin and have been described in the art. CPDs allow the transport of proteins across the plasma membrane and have also been described in the art. The ELD-CLD fusion proteins synergistically increase the transduction efficiency when compared to the co-transduction with either domain alone. In some embodiments, a histidine rich domain may optionally be added to the shuttle construct as an additional method of allowing the escape of the cargo from the endosome into the cytosol. The shuttle may also include a cysteine residue at the N or C terminus to generate multimers of the fusion peptide. Multimers of the ELD-CLD fusion peptides generated by the addition of cysteine residue to the terminus of the peptide show even greater transduction efficiency when compared to the single fusion peptide constructs. The polypeptides of the invention may also be appended to appropriate localization signals to direct the cargo to the appropriate sub-cellular location e.g. nucleus. In some embodiments any of the ELDs, CLDs or the fusion ELD-CLD synthetic peptides taught in the International Patent Publication, WO2016161516 and WO2017175072 may be useful in the present invention (the contents of each of which are herein incorporated by reference in their entirety).

2. Dosing

The present invention provides methods comprising administering any one or more compositions for immunotherapy to a subject in need thereof. These may be administered to a subject using any amount and any route of administration effective for preventing or treating a clinical condition such as cancer, infection diseases and other immunodeficient diseases.

Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, or prophylactically effective dose level for any particular patient will depend upon a variety of factors including the disorder being treated and the severity of the disorder; the activity of the specific compound employed; the specific composition employed; the age, body weight, general health, sex and diet of the patient; the time of administration, route of administration, previous or concurrent therapeutic interventions and rate of excretion of the specific compound employed; the duration of the treatment; drugs used in combination or coincidental with the specific compound employed; and like factors well known in the medical arts.

Compositions of the invention may be used in varying doses to avoid T cell energy, prevent cytokine release syndrome and minimize toxicity associated with immunotherapy. For example, low doses of the compositions of the present invention may be used to initially treat patients with high tumor burden, while patients with low tumor burden may be treated with high and repeated doses of the compositions of the invention to ensure recognition of a minimal tumor antigen load. In another instance, the compositions of the present invention may be delivered in a pulsatile fashion to reduce tonic T cell signaling and enhance persistence in vivo. In some aspects, toxicity may be minimized by initially using low doses of the compositions of the invention, prior to administering high doses. Dosing may be modified if serum markers such as ferritin, serum C-reactive protein, IL6, IFN-γ, and TNF-α are elevated.

In some embodiments, the neurotoxicity may be associated with CAR or TIL therapy. Such neurotoxicity may be associated CD19-CARs. Toxicity may be due to excessive T cell infiltration into the brain. In some embodiments, neurotoxicity may be alleviated by preventing the passage of T cells through the blood brain barrier. This can be achieved by the targeted gene deletion of the endogenous alpha-4 integrin inhibitors such as tysabri/natalizumab may also be useful in the present invention.

In some embodiments, the compositions of the invention may initially be delivered in a low priming single dose followed by a multiple dose regimen to limit the toxicity associated with IL12 (Lasek W, et al. (2014) *Cancer Immunol Immunother.* 63:419-35).

3. Administration

In some embodiments, the compositions for immunotherapy may be administered to cells ex vivo and subsequently administered to the subject. Immune cells can be isolated and expanded ex vivo using a variety of methods known in the art. For example, methods of isolating cytotoxic T cells are described in U.S. Pat. Nos. 6,805,861 and 6,531,451; the contents of each of which are incorporated herein by reference in their entirety. Isolation of NK cells is described in U.S. Pat. No. 7,435,596; the contents of which are incorporated by reference herein in its entirety.

In some embodiments, compositions of the present invention, may be administered by any of the methods of administration taught in the copending commonly owned U.S. Provisional Patent Application No. 62/320,864 filed on Apr. 11, 2016, or in U.S. Provisional Application No. 62/466,596 filed Mar. 3, 2017 and the International Publication WO2017/180587, the contents of each of which are incorporated herein by reference in their entirety.

In some embodiments, depending upon the nature of the cells, the cells may be introduced into a host organism e.g. a mammal, in a wide variety of ways including by injection, transfusion, infusion, local instillation or implantation. In some aspects, the cells of the invention may be introduced at the site of the tumor. The number of cells that are employed will depend upon a number of circumstances, the purpose for the introduction, the lifetime of the cells, the protocol to be used, for example, the number of administrations, the ability of the cells to multiply, or the like. The cells may be in a physiologically-acceptable medium.

In some embodiments, the cells of the invention may be administrated in multiple doses to subjects having a disease or condition. The administrations generally effect an improvement in one or more symptoms of cancer or a clinical condition and/or treat or prevent cancer or clinical condition or symptom thereof.

In some embodiments, the compositions for immunotherapy may be administered in vivo. In some embodiments, polypeptides of the present invention comprising biocircuits, effector molecules, SREs, payloads of interest (immunotherapeutic agents) and compositions of the invention may be delivered in vivo to the subject. In vivo delivery of immunotherapeutic agents is well described in the art. For example, methods of delivery of cytokines are described in the E.P. Pat. No.: EP0930892 A1, the contents of which are incorporated herein by reference.

In one embodiment, the payloads of the present invention may be administered in conjunction with inhibitors of SHP-1 and/or SHP-2. The tyrosine-protein phosphatase SHP1 (also known as PTPN6) and SHP2 (also known as PTPN11) are involved in the Programmed Cell Death (PD 1) inhibitory signaling pathway. The intracellular domain of PD1 contains an immunoreceptor tyrosine-based inhibitory motif (ITIM) and an immunoreceptor tyrosine-based switch motif (ITSM). ITSM has been shown to recruit SHP-1 and 2. This generates negative costimulatory micro clusters that induce the dephosphorylation of the proximal TCR signaling molecules, thereby resulting in suppression of T cell activation, which can lead to T cell exhaustion. In one embodiment, inhibitors of SHP-1 and 2 may include expressing dominant negative versions of the proteins in T cells, TILs or other cell types to relieve exhaustion. Such mutants can bind to the endogenous, catalytically active proteins, and inhibit their function. In one embodiment, the dominant negative mutant of SHP-1 and/or SHP-2 lack the phosphatase domain required for catalytic activity. In some embodiments, any of the dominant negative SHP-1 mutants taught Bergeron S et al. (2011). Endocrinology. 2011 December; 152(12):4581-8.; Dustin J B et al. (1999) J Immunol. March 1; 162(5):2717-24.; Berchtold S (1998) Mol Endocrinol. April; 12(4):556-67 and Schram et al. (2012) Am J Physiol Heart Circ Physiol. 1; 302(1):H231-43.; may be useful in the invention (the contents of each of which are incorporated by reference in their entirety).

Routes of Delivery

The pharmaceutical compositions, biocircuits, biocircuit components, effector modules including their SREs (e.g., DDs), payloads (i.e. immunotherapeutic agents), vectors and cells of the present invention may be administered by any route to achieve a therapeutically effective outcome.

These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intra-arterial (into an artery), intramuscular (into a muscle), intracranial (into the heart), intraosseous infusion (into the bone marrow), intrathecal (into the spinal canal), intraperitoneal, (infusion or injection into the peritoneum), intrasinal infusion, intravitreal, (through the eye), intravenous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intra-cartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal.

III. Pharmaceutical Compostions and Formulations

The present invention further provides pharmaceutical compositions comprising the DDs of the invention, one or more stimuli, effector modules and biocircuit systems comprising the same, and optionally at least one pharmaceutically acceptable excipient or inert ingredient.

As used herein the term "pharmaceutical composition" refers to a preparation of activate agents (e.g., DDs, ligands of the DDs, effector modules and biocircuits), other components, vectors, cells and described herein, or pharmaceutically acceptable salts thereof, optionally with other chemical components such as physiologically suitable carriers and excipients. The pharmaceutical compositions of the invention comprise an effective amount of one or more active compositions of the invention. The preparation of a pharmaceutical composition that contains at least one composition of the present invention and/or an additional active ingredient will be known to those skilled in the art in light of the present disclosure, as exemplified by Remington's Pharmaceutical Sciences, 18th Ed. Mack Printing Company, 1990, incorporated herein by reference.

The term "excipient" or "inert ingredient" refers to an inactive substance added to a pharmaceutical composition and formulation to further facilitate administration of an active ingredient. For the purposes of the present disclosure, the phrase "active ingredient" generally refers to any one or more biocircuits, effector modules, DDs, stimuli and payloads (i.e., immunotherapeutic agents), other components, vectors, and cells to be delivered as described herein. The phrases "pharmaceutically acceptable" refers to molecular entities and compositions that do not produce an adverse, allergic or other untoward reaction when administered to an animal, such as, for example, a human, as appropriate.

In some embodiments, pharmaceutical compositions and formulations are administered to humans, human patients or subjects. Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Subjects to which administration of the pharmaceutical compositions is contemplated include, but are not limited to, non-human mammals, including agricultural animals such as cattle, horses, chickens and pigs, domestic animals such as cats, dogs, or research animals such as mice, rats, rabbits, dogs and non-human primates. It will be understood that, for human administration, preparations should meet sterility, pyrogenicity, general safety and purity standards as required by FDA Office of Biological Standards.

A pharmaceutical composition and formulation in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

The compositions of the present invention may be formulated in any manner suitable for delivery. The formulation may be, but is not limited to, nanoparticles, poly (lactic-co-glycolic acid) (PLGA) microspheres, lipidoids, lipoplex, liposome, polymers, carbohydrates (including simple sugars), cationic lipids and combinations thereof.

In one embodiment, the formulation is a nanoparticle which may comprise at least one lipid. The lipid may be selected from, but is not limited to, DLin-DMA, DLin-K-DMA, 98N12-5, C12-200, DLin-MC3-DMA, DLin-KC2-

DMA, DODMA, PLGA, PEG, PEG-DMG and PEGylated lipids. In another aspect, the lipid may be a cationic lipid such as, but not limited to, DLin-DMA, DLin-D-DMA, DLin-MC3-DMA, DLin-KC2-DMA and DODMA.

For polynucleotides of the invention, the formulation may be selected from any of those taught, for example, in International Application PCT/US2012/069610, the contents of which are incorporated herein by reference in its entirety.

Relative amounts of the active ingredient, the pharmaceutically acceptable excipient or inert ingredient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of compositions of the present invention, "effective against" for example a cancer, indicates that administration in a clinically appropriate manner results in a beneficial effect for at least a statistically significant fraction of patients, such as an improvement of symptoms, a cure, a reduction in disease load, reduction in tumor mass or cell numbers, extension of life, improvement in quality of life, or other effect generally recognized as positive by medical doctors familiar with treating the particular type of cancer.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given composition or formulation of the present invention can also be judged using an experimental animal model for the given disease as known in the art. When using an experimental animal model, efficacy of treatment is evidenced when a statistically significant change is observed.

In some embodiments, the polypeptides of the invention may be delivered to the cell directly. In one embodiment, the polypeptides of the invention may be delivered using synthetic peptides comprising an endosomal leakage domain (ELD) fused to a cell penetration domain (CLD). The polypeptides of the invention are co introduced into the cell with the ELD-CLD-synthetic peptide. ELDs facilitate the escape of proteins that are trapped in the endosome, into the cytosol. Such domains are derived proteins of microbial and viral origin and have been described in the art. CPDs allow the transport of proteins across the plasma membrane and have also been described in the art. The ELD-CLD fusion proteins synergistically increase the transduction efficiency when compared to the co-transduction with either domain alone. In some embodiments, a histidine rich domain may optionally be added to the shuttle construct as an additional method of allowing the escape of the cargo from the endosome into the cytosol. The shuttle may also include a cysteine residue at the N or C terminus to generate multimers of the fusion peptide. Multimers of the ELD-CLD fusion peptides generated by the addition of cysteine residue to the terminus of the peptide show even greater transduction efficiency when compared to the single fusion peptide constructs. The polypeptides of the invention may also be appended to appropriate localization signals to direct the cargo to the appropriate sub-cellular location e.g. nucleus. In some embodiments any of the ELDs, CLDs or the fusion ELD-CLD synthetic peptides taught in the International Patent Publication, WO2016161516 and WO2017175072 may be useful in the present invention (the contents of each of which are herein incorporated by reference in their entirety).

Therapeutic Uses

1. Cancer

Various cancers may be treated with pharmaceutical compositions, biocircuits, biocircuit components, effector modules including their SREs or payloads of the present invention. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the compositions of the present invention include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphoma/leukemia, squamous cell carcinoma, small cell carcinoma, large cell undifferentiated carcinomas, basal cell carcinoma and sinonasal undifferentiated carcinoma.

Types of carcinomas which may be treated with the compositions of the present invention include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the carcinoma which may be treated may be Acute granulocytic leukemia, Acute lymphocytic leukemia, Acute myelogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stem glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epithelioid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Germ cell tumor, Glioblastoma multiforme, Glioma, Hairy cell leukemia, Head and neck cancer, Hemangioendothelioma, Hodgkin lymphoma, Hodgkin's disease, Hodgkin's lymphoma, Hypopharyngeal cancer, Infiltrating ductal carcinoma, Infiltrating lobular carcinoma, Inflammatory breast cancer, Intestinal Cancer, Intrahepatic bile duct cancer, Invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullary carcinoma, Medulloblastoma, Melanoma, Meningioma, Merkel cell carcinoma, Mesenchymal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple myeloma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soft tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

2. Combination Treatments

The invention further relates to the use of pharmaceutical compositions, biocircuits, biocircuit components, effector modules including their SREs or payloads of the present invention for treating one or more forms of cancer, in combination with other pharmaceuticals and/or other therapeutic methods, e.g., with known pharmaceuticals and/or known therapeutic methods, such as, for example, those which are currently employed for treating these disorders. For example, the pharmaceutical compositions, biocircuits, biocircuit components, effector modules including their SREs or payloads of the present invention can also be administered in conjunction with one or more additional anti-cancer treatments, such as biological, chemotherapy and radiotherapy. Accordingly, a treatment can include, for example, imatinib (Gleevac), all-trans-retinoic acid, a monoclonal antibody treatment (gemtuzumab, ozogamicin), chemotherapy (for example, chlorambucil, prednisone, prednisolone, vincristine, cytarabine, clofarabine, farnesyl transferase inhibitors, decitabine, inhibitors of MDR1), rituximab, interferon-$\alpha$, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, radiation therapy, anti-metabolite drugs (methotrexate and 6-mercaptopurine), or any of the antibodies taught herein such as those in Table 6 of the commonly owned U.S. Ser. No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety or combinations thereof.

3. Combinations with Radiation

Radiation therapy (also called radiotherapy, X-ray therapy, or irradiation) is the use of ionizing radiation to kill cancer cells and shrink tumors. Radiation therapy can be administered externally via external beam radiotherapy (EBRT) or internally via brachytherapy. The effects of radiation therapy are localized and confined to the region being treated. Radiation therapy may be used to treat almost every type of solid tumor, including cancers of the brain, breast, cervix, larynx, lung, pancreas, prostate, skin, stomach, uterus, or soft tissue sarcomas. Radiation is also used to treat leukemia and lymphoma.

4. Combination with Chemotherapy

Chemotherapy is the treatment of cancer with drugs that can destroy cancer cells. In current usage, the term "chemotherapy" usually refers to cytotoxic drugs which affect rapidly dividing cells in general, in contrast with targeted therapy. Chemotherapy drugs interfere with cell division in various possible ways, e.g. with the duplication of DNA or the separation of newly formed chromosomes. Most forms of chemotherapy target all rapidly dividing cells and are not specific to cancer cells, although some degree of specificity may come from the inability of many cancer cells to repair DNA damage, while normal cells generally can.

Most chemotherapy regimens are given in combination. Exemplary chemotherapeutic agents include, but are not limited to, 5-FU Enhancer, 9-AC, AG2037, AG3340, Aggrecanase Inhibitor, Aminoglutethimide, Amsacrine (m-AMSA), Asparaginase, Azacitidine, Batimastat (BB94), BAY 12-9566, BCH-4556, Bis-Naphtalimide, Busulfan, Capecitabine, Carboplatin, Carmustaine+ Polifepr Osan, cdk4/cdk2 inhibitors, Chlorambucil, CI-994, Cisplatin, Cladribine, CS-682, Cytarabine HCl, D2163, Dactinomycin, Daunorubicin HCl, DepoCyt, Dexifosamide, Docetaxel, Dolastain, Doxifluridine, Doxorubicin, DX8951f, E 7070, EGFR, Epirubicin, Erythropoietin, Estramustine phosphate sodium, Etoposide (VP16-213), Farnesyl Transferase Inhibitor, FK 317, Flavopiridol, Floxuridine, Fludarabine, Fluorouracil (5-FU), Flutamide, Fragyline, Gemcitabine, Hexamethylmelamine (HMM), Hydroxyurea (hydroxycarbamide), Ifosfamide, Interferon Alfa-2a, Interferon Alfa-2b, Interleukin-2, Irinotecan, ISI 641, Krestin, Lemonal DP 2202, Leuprolide acetate (LHRH-releasing factor analogue), Levamisole, LiGLA (lithium-gamma linolenate), Lodine Seeds, Lometexol, Lomustine (CCNU), Marimistat, Mechlorethamine HCl (nitrogen mustard), Megestrol acetate, Meglamine GLA, Mercaptopurine, Mesna, Mitoguazone (methyl-GAG; methyl glyoxal bis-guanylhydrazone; MGBG), Mitotane (o.p'-DDD), Mitoxantrone, Mitoxantrone HCl, MMI 270, MMP, MTA/LY 231514, Octreotide, ODN 698, OK-432, Oral Platinum, Oral Taxoid, Paclitaxel (TAXOL®), PARP Inhibitors, PD 183805, Pentostatin (2' deoxycoformycin), PKC 412, Plicamycin, Procarbazine HCl, PSC 833, Ralitrexed, RAS Farnesyl Transferase Inhibitor, RAS Oncogene Inhibitor, Semustine (methyl-CCNU), Streptozocin, Suramin, Tamoxifen citrate, Taxane Analog, Temozolomide, Teniposide (VM-26), Thioguanine, Thiotepa, Topotecan, Tyrosine Kinase, UFT (Tegafur/Uracil), Valrubicin, Vinblastine sulfate, Vindesine sulfate, VX-710, VX-853, YM 116, ZD 0101, ZD 0473/Anormed, ZD 1839, ZD 9331.

5. Immuno-Oncology and Cell Therapies

Recent progress in the field of cancer immunology has allowed the development of several approaches to help the immune system keep the cancer at bay. Such immunotherapy approaches include the targeting of cancer antigens through monoclonal antibodies or through adoptive transfer of ex vivo engineered T cells (e.g., which contain chimeric antigen receptors or engineered T cell receptors).

In some embodiments, pharmaceutical compositions, biocircuits, biocircuit components, effector modules including their SREs or payloads of the present invention may be used in the modulation or alteration or exploitation of the immune system to target one or more cancers. This approach may also be considered with other such biological approaches, e.g., immune response modifying therapies such as the administration of interferons, interleukins, colony-stimulating factors, other monoclonal antibodies, vaccines, gene therapy, and nonspecific immunomodulating agents are also envisioned as anti-cancer therapies to be combined with the pharmaceutical compositions, biocircuits, biocircuit components, effector modules including their SREs or payloads of the present invention.

Cancer immunotherapy refers to a diverse set of therapeutic strategies designed to induce the patient's own immune system to fight the cancer. In some embodiments, pharmaceutical compositions, biocircuits, biocircuit components, effector modules including their SREs or payloads of the present invention are designed as immune-oncology therapeutics.

6. Cell Therapies

There are several types of cellular immunotherapies, including tumor infiltrating lymphocyte (TIL) therapy, genetically engineered T cells bearing chimeric antigen receptors (CARs), and recombinant TCR technology.

According to the present invention, the biocircuits and systems may be used in the development and implementation of cell therapies such as adoptive cell therapy. The biocircuits, their components, effector modules and their SREs and payloads may be used in cell therapies to effect TCR removal-TCR gene disruption, TCR engineering, to regulate epitope tagged receptors, in APC platforms for stimulating T cells, as a tool to enhance ex vivo APC stimulation, to improve methods of T cell expansion, in ex vivo stimulation with antigen, in TCR/CAR combinations, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g by introducing cytokine genes, genes for the checkpoint inhibitors PD1, CTLA4).

In some embodiments, improved response rates are obtained in support of cell therapies.

Expansion and persistence of cell populations may be achieved through regulation or fine tuning of the payloads, e.g., the receptors or pathway components in T cells, NK cells or other immune-related cells. In some embodiments, biocircuits, their components, SREs or effector modules are designed to spatially and/or temporally control the expression of proteins which enhance T-cell or NK cell response. In some embodiments, biocircuits, their components, SREs or effector modules are designed to spatially and/or temporally control the expression of proteins which inhibit T-cell or NK cell response.

In some embodiments, biocircuits, their components, SREs or effector modules are designed to reshape the tumor microenvironment in order to extend utility of the biocircuit or a pharmaceutical composition beyond direct cell killing.

In some embodiments, biocircuits, their components, SREs or effector modules are designed to reduce, mitigate or eliminate the CAR cytokine storm. In some embodiments such reduction, mitigation and/or elimination occurs in solid tumors or tumor microenvironments.

In some embodiments the effector modules may encode one or more cytokines. In some embodiments, the cytokine is IL15. Effector modules encoding IL15 may be designed to induce proliferation in cytotoxic populations and avoid stimulation of T regs. In other cases, the effector modules which induce proliferation in cytotoxic populations may also stimulate NK and NKT cells.

In some embodiments, effector modules may encode, or be tuned or induced to produce, one or more cytokines for expansion of cells in the biocircuits of the invention. In such cases the cells may be tested for actual expansion. Expansion may be at least 5%, 10%, 20%, 30%, 40%, 50%, 60%, 70%, 80%, 90% or more.

In some embodiments, the tumor microenvironment may be remodeled using a biocircuit containing an effector module encoding IL17.

In some embodiments, biocircuits, their components, SREs or effector modules are designed to modulate Tregs to attenuate autoimmune disorders. In such a case, L2 may be regulated using a singly tuned module or one having multiple tuned features as described herein.

In some embodiments, biocircuits, their components, SREs or effector modules are designed to be significantly less immunogenic than other biocircuits or switches in the art.

As used herein, "significantly less immunogenic" refers to a detectable decrease in immunogenicity. In another embodiment, the term refers to a fold decrease in immunogenicity. In another embodiment, the term refers to a decrease such that an effective amount of the biocircuits, their components, SREs or effector modules which can be administered without triggering a detectable immune response. In another embodiment, the term refers to a decrease such that the biocircuits, their components, SREs or effector modules can be repeatedly administered without eliciting an immune response. In another embodiment, the decrease is such that the biocircuits, their components, SREs or effector modules can be repeatedly administered without eliciting an immune response.

In another embodiment, the biocircuits, their components, SREs or effector modules is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL12, IFNalpha, TNF-alpha, RANTES, MIP-1alpha or beta, IL6, IFN-beta, or IL8), measuring expression of DC activation markers (e.g. CD83, HLA-DR, CD80 and CD86), or measuring ability to act as an adjuvant for an adaptive immune response.

In one embodiment, the chimeric antigen receptor (CAR) of the present invention may be a conditionally active CAR. A wild type protein or domain thereof, such as those described herein may be used to generate a conditionally active biologic protein which are reversibly or irreversibly inactivated at the wild type normal physiological conditions as well as to such conditionally active biologic proteins and domains and uses of such conditional active biologic proteins and domains are provided. Such methods and conditionally active proteins are taught in, for example, International Publication No. WO2016033331, the contents of which are incorporated herein by reference in their entirety. As a non-limiting example, the CAR comprises at least one antigen specific targeting region evolved from a wild type protein or a domain thereof and one or more of a decrease in activity in the assay at the normal physiological condition compared to the antigen specific targeting region of the wild-type protein or a domain thereof, and an increase in activity in the assay under the aberrant condition compared to the antigen specific targeting region of the wild-type protein or a domain thereof.

7. Diseases and Toxins

Various infectious diseases may be treated with pharmaceutical compositions, biocircuits, biocircuit components, effector modules including their SREs or payloads of the present invention. As used herein, the term "infectious disease" refers to any disorders caused by organisms such as bacteria, viruses, fungi or parasites. As a non-limiting example, the infectious disease may be Acute bacterial rhinosinusitis, 14-day measles, Acne, Acrodermatitis chronica atrophicans (ACA)-(late skin manifestation of latent Lyme disease), Acute hemorrhagic conjunctivitis, Acute hemorrhagic cystitis, Acute rhinosinusitis, Adult T-cell Leukemia-Lymphoma (ATLL), African Sleeping Sickness, AIDS (Acquired Immunodeficiency Syndrome), Alveolar hydatid, Amebiasis, Amebic meningoencephalitis, Anaplasmosis, Anthrax, Arboviral or parainfectious, Ascariasis-(Roundworm infections), Aseptic meningitis, Athlete's foot (Tinea pedis), Australian tick typhus, Avian Influenza, Babesiosis, Bacillary angiomatosis, Bacterial meningitis, Bacterial vaginosis, Balanitis, Balantidiasis, Bang's disease, Barmah Forest virus infection, Bartonellosis (Verruga peruana; Carrion's disease; Oroya fever), Bat Lyssavirus Infection, Bay sore (Chiclero's ulcer), *Baylisascaris* infection (Racoon roundworm infection), Beaver fever, Beef tapeworm, Bejel (endemic syphilis), Biphasic meningoencephalitis, Black Bane, Black death, Black *piedra*, Blackwater Fever, Blastomycosis, Blennorrhea of the newborn, Blepharitis, Boils, Bornholm disease (pleurodynia), *Borrelia miyamotoi* Disease, Botulism, Boutonneuse fever, Brazilian purpuric fever, Break Bone fever, Brill, Bronchiolitis, Bronchitis, Brucellosis (Bang's disease), Bubonic plague, Bullous impetigo, *Burkholderia mallei* (Glanders), *Burkholderia pseudomallei* (Melioidosis), Buruli ulcers (also Mycoburuli ulcers), Busse, Busse-Buschke disease (Cryptococcosis), California group encephalitis, Campylobacteriosis, Candidiasis, Canefield fever (*Canicola* fever; 7-day fever; Weil's disease; leptospirosis; canefield fever), *Canicola* fever, Capillariasis, Carate, Carbapenem-resistant Enterobacteriaceae (CRE), Carbuncle, Carrion's disease, Cat Scratch fever, Cave disease, Central Asian hemorrhagic fever, Central European tick, Cervical cancer, Chagas disease, Chancroid (Soft chancre), Chicago disease, Chickenpox (Varicella), Chiclero's ulcer, Chikungunya fever, Chlamydial infection, Cholera, Chromoblastomycosis, Ciguatera, Clap, Clonorchiasis (Liver fluke infection), *Clostridium Difficile* Infection, *ClostriDium Perfringens* (Epsilon Toxin), Coccidioidomycosis fungal infection (Valley fever; desert rheumatism), Coenurosis, Colorado tick fever, Condyloma accuminata, Condyloma accuminata (Warts), Condyloma lata, Congo fever, Congo hemorrhagic fever virus, Conjunctivitis, cowpox, Crabs, Crimean, Croup, Cryptococcosis, Cryptosporidiosis (Crypto), Cutaneous Larval Migrans, Cyclosporiasis, Cystic hydatid, Cysticercosis, Cystitis, Czechoslovak tick, D68 (EV-D68), Dacryocytitis, Dandy fever, Darling's Disease, Deer fly fever, Dengue fever (1, 2, 3 and 4), Desert rheumatism, Devil's grip, Diphasic milk fever, Diphtheria, Disseminated Intravascular Coagulation, Dog tapeworm, Donovanosis, Donovanosis (Granuloma inguinale), Dracontiasis, Dracunculosis, Duke's disease, Dum Dum Disease, Durand-Nicholas-Favre disease, Dwarf tapeworm, *E. Coli* infection (*E. coli*), Eastern equine encephalitis, Ebola Hemorrhagic Fever (Ebola virus disease EVD), Ectothrix, Ehrlichiosis (*Sennetsu* fever), Encephalitis, Endemic Relapsing fever, Endemic syphilis, Endophthalmitis, Endothrix, Enterobiasis (Pinworm infection), Enterotoxin-B Poisoning (Staph Food Poisoning), Enterovirus Infection, Epidemic Keratoconjunctivitis, Epidemic Relapsing fever, Epidemic typhus, Epiglottitis, Erysipelis, Erysipeloid (Erysipelothricosis), Erythema chronicum migrans, Erythema infectiosum, Erythema *marginatum*, Erythema multiforme, Erythema nodosum, Erythema nodosum leprosum, Erythrasma, Espundia, Eumycotic mycetoma, European blastomycosis, Exanthem subitum (Sixth disease), Eyeworm, Far Eastern tick, Fascioliasis, Fievre boutonneuse (Tick typhus), Fifth Disease (erythema infectiosum), Filatow-Dukes' Disease (Scalded Skin Syndrome; Ritter's Disease), Fish tapeworm, Fitz-Hugh-Curtis syndrome-Perihepatitis, Flinders Island Spotted Fever, Flu (Influenza), Folliculitis, Four Corners Disease, Four Corners Disease (Human Pulmonary Syndrome (HPS)), Frambesia, Francis disease, Furunculosis, Gas gangrene, Gastroenteritis, Genital Herpes, Genital Warts, German measles, Gerstmann-Straussler-Scheinker (GSS), Giardiasis, Gilchrist's disease, Gingivitis, Gingivostomatitis, Glanders, Glandular fever (infectious mononucleosis), Gnathostomiasis, Gonococcal Infection (Gonorrhea), Gonorrhea, Granuloma inguinale (Donovanosis), Guinea Worm, *Haemophilus* Influenza disease, Hamburger disease, Hansen's disease-leprosy, Hantaan disease, Hantaan-Korean hemorrhagic fever, Hantavirus Pulmonary Syndrome, Hantavirus Pulmonary Syndrome (HPS), Hard chancre, Hard measles, Haverhill fever-Rat bite fever, Head and Body Lice, Heartland fever, Helicobacterosis, Hemolytic Uremic Syndrome (HUS), Hepatitis A, Hepatitis B, Hepatitis C, Hepatitis D, Hepatitis E, Herpangina, Herpes-genital, Herpes labialis, Herpes-neonatal, Hidradenitis, Histoplasmosis, Histoplasmosis infection (Histoplasmosis), His-Werner disease, HIV infection, Hookworm infections, Hordeola, Hordeola (Stye), HTLV, HTLV-associated myelopathy (HAM), Human granulocytic ehrlichiosis, Human monocytic ehrlichiosis, Human Papilloma virus (HPV), Human Pulmonary Syndrome, Hydatid cyst, Hydrophobia, Impetigo, Including congenital (German Measles), Inclusion conjunctivitis, Inclusion conjunctivitis-~Swimming Pool conjunctivitis-Pannus, Infantile diarrhea, Infectious Mononucleosis, Infectious myocarditis, Infectious pericarditis, Influenza, Isosporiasis, Israeli spotted fever, Japanese Encephalitis, Jock itch, Jorge Lobo disease—lobomycosis, Jungle yellow fever, Junin Argentinian hemorrhagic fever, Kala Azar, Kaposi's sarcoma, Keloidal blastomycosis, Keratoconjunctivitis, Kuru, Kyasanur forest disease, LaCrosse encephalitis, Lassa hemorrhagic fever, Legionellosis (Legionnaires Disease), Legionnaire's pneumonia, Lemierre's Syndrome (Postanginal septicemia), Lemming fever, Leprosy, Leptospirosis (Nanukayami fever; Weil's disease), Listeriosis (*Listeria*), Liver fluke infection, Lobo's mycosis, Lockjaw, Loiasis, Louping Ill, Ludwig's angina, Lung fluke infection, Lung fluke infection (Paragonimiasis), Lyme disease, Lymphogranuloma venereum infection (LGV), Machupo Bolivian hemorrhagic fever, Madura foot, Mal del pinto, Malaria, Malignant pustule, Malta fever, Marburg hemorrhagic fever, Masters disease, Maternal Sepsis (Puerperal fever), Measles, Mediterranean spotted fever, Melioidosis (Whitmore's disease), Meningitis, Meningococcal Disease, MERS, Milker's nodule, Molluscum contagiosum, Moniliasis, monkeypox, Mononucleosis, Mononucleosis-like syndrome, Montezuma's Revenge, Morbilli, MRSA (methicillin-resistant *Staphylococcus aureus*) infection, Mucormycosis-Zygomycosis, Multiple Organ Dysfunction Syndrome or MODS, Multiple-system atrophy (MSA), Mumps, Murine typhus, Murray Valley Encephalitis (MVE), Mycoburuli ulcers, Mycoburuli ulcers-Buruli ulcers, Mycotic vulvovaginitis, Myositis, Nanukayami fever, Necrotizing fasciitis, Necrotizing fasciitis-Type 1, Necrotizing fasciitis-Type 2, Negishi, New world spotted fever, Nocardiosis, Nongonococcal urethritis, Non-Polio (Non-Polio Enterovirus), Norovirus infection, North American blastomycosis, North Asian tick typhus, Norwalk virus infection, Norwegian itch, O'Hara disease, Omsk hemorrhagic fever, Onchoceriasis, Onychomycosis, Opisthorchiasis, Opthalmia neonatorium, Oral hairy leukoplakia, Orf, Oriental Sore, Oriental Spotted Fever, Ornithosis (Parrot fever; Psittacosis), Oroya fever, Otitis externa, Otitis media, Pannus, Paracoccidioidomycosis, Paragonimiasis, Paralytic Shellfish Poisoning (Paralytic Shellfish Poisoning), Paronychia (Whitlow), Parotitis, PCP pneumonia, Pediculosis, Peliosis *hepatica*, Pelvic Inflammatory Disease, Pertussis (also called Whooping cough), Phaeohyphomycosis, Pharyngoconjunctival fever, *Piedra* (White *Piedra*), *Piedra*(Black *Piedra*), Pigbel, Pink eye conjunctivitis, Pinta, Pinworm infection, Pitted Keratolysis, *Pityriasis versicolor* (Tinea *versicolor*), Plague; Bubonic, Pleurodynia, Pneumococcal Disease, Pneumocystosis, Pneumonia, Pneumonic (Plague), Polio or Poliomyelitis, Polycystic hydatid, Pontiac fever, Pork tapeworm, Posada-Wernicke disease, Postanginal septicemia, Powassan, Progressive multifocal leukencephalopathy, Progressive Rubella Panencephalitis, Prostatitis, Pseudomembranous colitis, Psittacosis, Puerperal fever, Pustular Rash diseases (Small pox), Pyelonephritis, Pylephlebitis, Q-Fever, Quinsy, *Quintana* fever (5-day fever), Rabbit fever, Rabies, Racoon roundworm infection, Rat bite fever, Rat tapeworm, Reiter Syndrome, Relapsing fever, Respiratory syncytial virus (RSV) infection, Rheumatic fever, Rhodotorulosis, Ricin Poisoning, Rickettsialpox, Rickettsiosis, Rift Valley Fever, Ringworm, Ritter's Disease, River Blindness, Rocky Mountain spotted fever, Rose Handler's disease (Sporotrichosis), Rose rash of infants, Roseola, Ross River fever, Rotavirus infection, Roundworm infections, Rubella, Rubeola, Russian spring, *Salmonellosis* gastroenteritis, San Joaquin Valley fever, Sao Paulo Encephalitis, Sao Paulo fever, SARS, Scabies Infestation (Scabies) (Norwegian itch), Scalded Skin Syndrome, Scarlet fever (Scarlatina), Schistosomiasis, Scombroid, Scrub typhus, *Sennetsu* fever, Sepsis (Septic shock), Severe Acute Respiratory Syndrome, Severe Acute Respiratory Syndrome (SARS), Shiga Toxigenic *Escherichia coli* (STEC/VTEC), Shigellosis gastroenteritis (*Shigella*), Shinbone fever, Shingles, Shipping fever, Siberian tick typhus, Sinusitis, Sixth disease, Slapped cheek disease, Sleeping sickness, Smallpox (Variola), Snail Fever, Soft chancre, Southern tick associated rash illness, Sparganosis, Spelunker's disease, Sporadic typhus, Sporotrichosis, Spotted fever, Spring, St. Louis encephalitis, Staphylococcal Food Poisoning, Staphylococcal Infection, Strep. throat, Streptococcal Disease, Streptococcal Toxic-Shock Syndrome, Strongyloiciasis, Stye, Subacute Sclerosing Panencephalitis, Subacute Sclerosing Panencephalitis (SSPE), Sudden Acute Respiratory Syndrome, Sudden Rash, Swimmer's ear, Swimmer's Itch, Swimming Pool conjunctivitis, Sylvatic yellow fever, Syphilis, Systemic Inflammatory Response Syndrome (SIRS), Tabes *dorsalis* (tertiary syphilis), Taeniasis, Taiga encephalitis, Tanner's disease, Tapeworm infections, Temporal lobe encephalitis, Temporal lobe encephalitis, *tetani* (Lock Jaw), Tetanus Infection, Threadworm infections, Thrush, Tick, Tick typhus, Tinea barbae, Tinea capitis, Tinea corporis, Tinea cruris, Tinea manuum, Tinea nigra, Tinea pedis, Tinea unguium, Tinea *versicolor*, Torulopsosis, Torulosis, Toxic Shock Syndrome, Toxoplasmosis, transmissible spongioform (CJD), Traveler's diarrhea, Trench fever 5, Trichinellosis, Trichomoniasis, Trichomycosis *axillaris*, Trichuriasis, Tropical Spastic Paraparesis (TSP), Trypanosomiasis, Tuberculosis (TB), Tuberculosis, Tularemia, Typhoid Fever, Typhus fever, Ulcus molle, Undulant fever, Urban yellow fever, Urethritis, Vaginitis, Vaginosis, Vancomycin Intermediate (VISA), Vancomycin Resistant (VRSA), Varicella, Venezuelan Equine encephalitis, Verruga peruana, *Vibrio cholerae* (Cholera), Vibriosis (*Vibrio*), Vincent's disease or Trench mouth, Viral conjunctivitis, Viral Meningitis, Viral meningoencephalitis, Viral rash, Visceral Larval Migrans, Vomito negro, Vulvovaginitis, Warts, Waterhouse, Weil's disease, West Nile Fever, Western equine encephalitis, Whipple's disease, Whipworm infection, White *Piedra*, Whitlow, Whitmore's disease, Winter diarrhea, Wolhynia fever, Wool sorters' disease, Yaws, Yellow Fever, Yersinosis, Yersinosis (*Yersinia*), Zahorsky's disease, Zika virus disease, Zoster, Zygomycosis, John Cunningham Virus (JCV), Human immunodeficiency virus (HIV), Influenza virus, Hepatitis B, Hepatitis C, Hepatitis D, Respiratory syncytial virus (RSV), Herpes simplex virus 1 and 2, Human Cytomegalovirus, Epstein-Barr virus, Varicella zoster virus, Coronaviruses, Poxviruses, Enterovirus 71, Rubella virus, Human papilloma virus, *Streptococcus pneumoniae*, *Streptococcus viridans*., *Staphylococcus aureus* (*S. aureus*), Methicillin-resistant *Staphylococcus aureus* (MRSA), Vancomycin-intermediate *Staphylococcus aureus* (VISA), Vancomycin-resistant *Staphylococcus aureus* (VRSA), *Staphylococcus epidermidis* (*S. epidermidis*), *Clostridium Tetani*, *Bordetella pertussis*, *Bordetella paratussis*, *Mycobacterium*, *Francisella Tularensis*, *Toxo-* plasma gondii, Candida (*C. albicans, C. glabrata, C. parapsilosis, C. tropicalis, C. krusei* and *C. lusitaniae*) and/or any other infectious diseases, disorders or syndromes.

Various toxins may be treated with pharmaceutical compositions, biocircuits, biocircuit components, effector modules including their SREs or payloads of the present invention. Non-limited examples of toxins include Ricin, *Bacillus anthracis*, Shiga toxin and Shiga-like toxin, Botulinum toxins.

Various tropical diseases may be treated with pharmaceutical compositions, biocircuits, biocircuit components, effector modules including their SREs or payloads of the present invention. Non-limited examples of tropical diseases include Chikungunya fever, Dengue fever, Chagas disease, Rabies, Malaria, Ebola virus, Marburg virus, West Nile Virus, Yellow Fever, Japanese encephalitis virus, St. Louis encephalitis virus.

Various foodborne illnesses and gastroenteritis may be treated with pharmaceutical compositions, biocircuits, biocircuit components, effector modules including their SREs or payloads of the present invention. Non-limited examples of foodborne illnesses and gastroenteritis include Rotavirus, Norwalk virus (Norovirus), *Campylobacter jejuni, Clostridium difficile, Entamoeba histolytica, Helicobacter pylori*, Enterotoxin B of *Staphylococcus aureus*, Hepatitis A virus (HAV), Hepatitis E, *Listeria monocytogenes, Salmonella, Clostridium perfringens*, and *Salmonella*.

Various infectious agents may be treated with pharmaceutical compositions, biocircuits, biocircuit components, effector modules including their SREs or payloads of the present invention. Non-limited examples of infectious agents include adenoviruses, *Anaplasma phagocytophilium, Ascaris lumbricoides, Bacillus anthracis, Bacillus cereus, Bacteroides* sp, Barmah Forest virus, *Bartonella bacilliformis, Bartonella henselae, Bartonella quintana*, beta-toxin of *Clostridium perfringens, Bordetella pertussis, Bordetella parapertussis, Borrelia burgdorferi, Borrelia miyamotoi, Borrelia recurrentis, Borrelia* sp., Botulinum toxin, *Brucella* sp., *Burkholderia pseudomallei*, California encephalitis virus, *Campylobacter, Candida albicans*, chikungunya virus, *Chlamydia psittaci, Chlamydia trachomatis, Clonorchis sinensis, Clostridium difficile* bacteria, *Clostridium tetani*, Colorado tick fever virus, *Corynebacterium diphtheriae, Corynebacterium minutissimum, Coxiella burnetii*, coxsackie A, coxsackie B, Crimean-Congo hemorrhagic fever virus, cytomegalovirus, dengue virus, Eastern Equine encephalitis virus, Ebola viruses, echovirus, *Ehrlichia chaffeensis., Ehrlichia* equi., *Ehrlichia* sp., *Entamoeba histolytica, Enterobacter* sp., Enterococcusfaecalis, Enterovirus 71, Epstein-Barr virus (EBV), *Erysipelothrix rhusiopathiae, Escherichia coli, Flavivirus, Fusobacterium necrophorum, Gardnerella vaginalis*, Group B *streptococcus, Haemophilus aegyptius, Haemophilus ducreyi, Haemophilus influenzae*, hantavirus, *Helicobacter pylori*, Hepatitis A, Hepatitis B, Hepatitis C, Hepatitis D, Hepatitis E, herpes simplex virus 1 and 2, human herpes virus 6, human herpes Virus 8, human immunodeficiency virus 1 and 2, human T-cell leukemia viruses I and II, influenza viruses (A, B, C), Jamestown Canyon virus, Japanese encephalitis antigenic, Japanese encephalitis virus, John Cunninham virus, juninvirus, Kaposi's Sarcoma-associated Herpes Virus (KSHV), *Klebsiella granulomatis, Klebsiella* sp., Kyasanur Forest Disease virus, La Crosse virus, Lassavirus, *Legionella pneumophila, Leptospira interrogans, Listeria monocytogenes*, lymphocytic choriomeningitis virus, lyssavirus, Machupovirus, Marburg virus, measles virus, MERS coronavirus (MERS-CoV), *Micrococcus sedentarius, Mobiluncus* sp., *Molluscipoxvirus, Moraxella catarrhalis*, Morbilli-Rubeola virus, Mumpsvirus, *Mycobacterium leprae, Mycobacterium tuberculosis, Mycobacterium ulcerans, Mycoplasma genitalium, Mycoplasma* sp, Nairovirus, *Neisseria gonorrhoeae, Neisseria meningitidis, Nocardia*, Norwalk virus, norovirus, Omsk hemorrhagic fever virus, papilloma virus, parainfluenza viruses 1-3, parapoxvirus, parvovirus B19, *Peptostreptococccus* sp., *Plasmodium* sp., polioviruses types I, II, and III, *Proteus* sp., *Pseudomonas aeruginosa, Pseudomonas pseudomallei, Pseudomonas* sp., rabies virus, respiratory syncytial virus, ricin toxin, *Rickettsia australis, Rickettsia conori, Rickettsia honei, Rickettsia prowazekii*, Ross River Virus, rotavirus, rubellavirus, Saint Louis encephalitis, *Salmonella Typhi, Sarcoptes scabiei*, SARS-associated coronavirus (SARS-CoV), *Serratia* sp., Shiga toxin and Shiga-like toxin, *Shigella* sp., Sin Nombre Virus, Snowshoe hare virus, *Staphylococcus aureus, Staphylococcus epidermidis, Streptobacillus moniliformis, Streptococcus pneumoniae, Streptococcus agalactiae, Streptococcus agalactiae, Streptococcus* group A-H, *Streptococcus pneumoniae, Streptococcus pyogenes, Treponema pallidum* subsp. *Pallidum, Treponema pallidum* var. *carateum, Treponema pallidum* var. *endemicum, Tropheryma whippelii, Ureaplasma urealyticum*, Varicella-Zoster virus, variola virus, *Vibrio cholerae*, West Nile virus, yellow fever virus, *Yersinia enterocolitica, Yersinia pestis*, and Zika virus.

Various rare diseases may be treated with pharmaceutical compositions, biocircuits, biocircuit components, effector modules including their SREs or payloads of the present invention. As used herein, the term "rare disease" refers to any disease that affects a small percentage of the population. As a non-limiting example, the rare disease may be Acrocephalosyndactylia, Acrodermatitis, Addison Disease, Adie Syndrome, Alagille Syndrome, Amylose, Amyotrophic Lateral Sclerosis, Angelman Syndrome, Angiolymphoid Hyperplasia with Eosinophilia, Arnold-Chiari Malformation, Arthritis, Juvenile Rheumatoid, Asperger Syndrome, Bardet-Biedl Syndrome, Barrett Esophagus, Beckwith-Wiedemann Syndrome, Behcet Syndrome, Bloom Syndrome, Bowen's Disease, Brachial Plexus Neuropathies, Brown-Sequard Syndrome, Budd-Chiari Syndrome, Burkitt Lymphoma, Carcinoma 256, Walker, Caroli Disease, Charcot-Marie-Tooth Disease, Chediak-Higashi Syndrome, Chiari-Frommel Syndrome, Chondrodysplasia Punctata, Colonic Pseudo-Obstruction, Colorectal Neoplasms, Hereditary Nonpolyposis, Craniofacial Dysostosis, Creutzfeldt-Jakob Syndrome, Crohn Disease, Cushing Syndrome, Cystic Fibrosis, Dandy-Walker Syndrome, De Lange Syndrome, Dementia, Vascular, Dermatitis Herpetiformis, DiGeorge Syndrome, Diffuse Cerebral Sclerosis of Schilder, Duane Retraction Syndrome, Dupuytren Contracture, Ebstein Anomaly, Eisenmenger Complex, Ellis-Van Creveld Syndrome, Encephalitis, Enchondromatosis, Epidermal Necrolysis, Toxic, Facial Hemiatrophy, Factor XII Deficiency, Fanconi Anemia, Felty's Syndrome, Fibrous Dysplasia, Polyostotic, Fox-Fordyce Disease, Friedreich Ataxia, *Fusobacterium*, Gardner Syndrome, Gaucher Disease, Gerstmann Syndrome, Giant Lymph Node Hyperplasia, Glycogen Storage Disease Type I, Glycogen Storage Disease Type II, Glycogen Storage Disease Type IV, Glycogen Storage Disease Type V, Glycogen Storage Disease Type VII, Goldenhar Syndrome, Guillain-Barre Syndrome, Hallermann's Syndrome, Hamartoma Syndrome, Multiple, Hartnup Disease, Hepatolenticular Degeneration, Hepatolenticular Degeneration, Hereditary Sensory and Motor Neuropathy, Hirschsprung Disease, Histiocytic Necrotizing Lymphadenitis, Histiocytosis, Langerhans-Cell, Hodgkin Disease, Homer Syndrome, Huntington Disease, Hyperaldosteronism, Hyperhidrosis, Hyperostosis, Diffuse Idiopathic Skeletal, Hypopituitarism, Inappropriate ADH Syndrome, Intestinal Polyps, Isaacs Syndrome, Kartagener Syndrome, Kearns-Sayre Syndrome, Klippel-Feil Syndrome, Klippel-Trenaunay-Weber Syndrome, Kluver-Bucy Syndrome, Korsakoff Syndrome, Lafora Disease, Lambert-Eaton Myasthenic Syndrome, Landau-Kleffner Syndrome, Langer-Giedion Syndrome, Leigh Disease, Lesch-Nyhan Syndrome, Leukodystrophy, Globoid Cell, Li-Fraumeni Syndrome, Long QT Syndrome, Machado-Joseph Disease, Mallory-Weiss Syndrome, Marek Disease, Marfan Syndrome, Meckel Diverticulum, Meige Syndrome, Melkersson-Rosenthal Syndrome, Meniere Disease, Mikulicz' Disease, Miller Fisher Syndrome, Mobius Syndrome, Moyamoya Disease, Mucocutaneous Lymph Node Syndrome, Mucopolysaccharidosis I, Mucopolysaccharidosis II, Mucopolysaccharidosis III, Mucopolysaccharidosis IV, Mucopolysaccharidosis VI, Multiple Endocrine Neoplasia Type 1, Munchausen Syndrome by Proxy, Muscular Atrophy, Spinal, Narcolepsy, Neuroaxonal Dystrophies, Neuromyelitis Optica, Neuronal Ceroid-Lipofuscinoses, Niemann-Pick Diseases, Noonan Syndrome, Optic Atrophies, Hereditary, Osteitis Deformans, Osteochondritis, Osteochondrodysplasias, Osteolysis, Essential, Paget Disease Extramammary, Paget's Disease, Mammary, Panniculitis, Nodular Nonsuppurative, Papillon-Lefevre Disease, Paralysis, Pelizaeus-Merzbacher Disease, Pemphigus, Benign Familial, Penile Induration, Pericarditis, Constrictive, Peroxisomal Disorders, Peutz-Jeghers Syndrome, Pick Disease of the Brain, Pierre Robin Syndrome, Pigmentation Disorders, *Pityriasis* Lichenoides, Polycystic Ovary Syndrome, Polyendocrinopathies, Autoimmune, Prader-Willi Syndrome, Pupil Disorders, Rett Syndrome, Reye Syndrome, Rubinstein-Taybi Syndrome, Sandhoff Disease, Sarcoma, Ewing's, Schnitzler Syndrome, Sjogren's Syndrome, Sjogren-Larsson Syndrome, Smith-Lemli-Opitz Syndrome, Spinal Muscular Atrophies of Childhood, Sturge-Weber Syndrome, Sweating, Gustatory, Takayasu Arteritis, Tangier Disease, Tay-Sachs Disease, Thromboangiitis Obliterans, Thyroiditis, Autoimmune, Tietze's Syndrome, Togaviridae Infections, Tolosa-Hunt Syndrome, Tourette Syndrome, Uveomeningoencephalitic Syndrome, Waardenburg's Syndrome, Wegener Granulomatosis, Weil Disease, Werner Syndrome, Williams Syndrome, Wilms Tumor, Wolff-Parkinson-White Syndrome, Wolfram Syndrome, Wolman Disease, Zellweger Syndrome, Zollinger-Ellison Syndrome, and von Willebrand Diseases.

Various autoimmune diseases and autoimmune-related diseases may be treated with pharmaceutical compositions, biocircuits, biocircuit components, effector modules including their SREs or payloads of the present invention. As used herein, the term "autoimmune disease" refers to a disease in which the body produces antibodies that attack its own tissues. As a non-limiting example, the autoimmune disease may be Acute Disseminated Encephalomyelitis (ADEM), Acute necrotizing hemorrhagic leukoencephalitis, Addison's disease, Agammaglobulinemia, Alopecia areata, Amyloidosis, Ankylosing spondylitis, Anti-GBM/Anti-TBM nephritis, Antiphospholipid syndrome (APS), Autoimmune angioedema, Autoimmune aplastic anemia, Autoimmune dysautonomia, Autoimmune hepatitis, Autoimmune hyperlipidemia, Autoimmune immunodeficiency, Autoimmune inner ear disease (AIED), Autoimmune myocarditis, Autoimmune oophoritis, Autoimmune pancreatitis, Autoimmune retinopathy, Autoimmune thrombocytopenic purpura (ATP), Autoimmune thyroid disease, Autoimmune urticaria, Axonal & neuronal neuropathies, Balo disease, Behcet's disease, Bullous pemphigoid, Cardiomyopathy, Castleman disease, Celiac disease, Chagas disease, Chronic fatigue syndrome, Chronic inflammatory demyelinating polyneuropathy (CIDP), Chronic recurrent multifocal ostomyelitis (CRMO), Churg-Strauss syndrome, Cicatricial pemphigoid/benign mucosal pemphigoid, Crohn's disease, Cogans syndrome, Cold agglutinin disease, Congenital heart block, Coxsackie myocarditis, CREST disease, Essential mixed cryoglobulinemia, Demyelinating neuropathies, Dermatitis herpetiformis, Dermatomyositis, Devic's disease (neuromyelitis optica), Discoid lupus, Dressler's syndrome, Endometriosis, Eosinophilic esophagitis, Eosinophilic fasciitis, Erythema nodosum, Experimental allergic encephalomyelitis, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis (GPA) (formerly called Wegener's Granulomatosis), Graves' disease, Guillain-Barre syndrome, Hashimoto's encephalitis, Hashimoto's thyroiditis, Hemolytic anemia, Henoch-Schonlein purpura, Herpes gestationis, Hypogammaglobulinemia, Idiopathic thrombocytopenic purpura (ITP), IgA nephropathy, IgG4-related sclerosing disease, Immunoregulatory lipoproteins, Inclusion body myositis, Interstitial cystitis, Juvenile arthritis, Juvenile diabetes (Type 1 diabetes), Juvenile myositis, Kawasaki syndrome, Lambert-Eaton syndrome, Leukocytoclastic vasculitis, Lichen planus, Lichen sclerosus, Ligneous conjunctivitis, Linear IgA disease (LAD), Lupus (SLE), Lyme disease, chronic, Meniere's disease, Microscopic polyangiitis, Mixed connective tissue disease (MCTD), Mooren's ulcer, Mucha-Habermann disease, Multiple sclerosis, Myasthenia gravis, Myositis, Narcolepsy, Neuromyelitis optica (Devic's), Neutropenia, Ocular cicatricial pemphigoid, Optic neuritis, Palindromic rheumatism, PANDAS (Pediatric Autoimmune Neuropsychiatric Disorders Associated with *Streptococcus*), Paraneoplastic cerebellar degeneration, Paroxysmal nocturnal hemoglobinuria (PNH), Parry Romberg syndrome, Parsonnage-Turner syndrome, Pars planitis (peripheral uveitis), Pemphigus, Peripheral neuropathy, Perivenous encephalomyelitis, Pernicious anemia, POEMS syndrome, Polyarteritis *nodosa*, Type I, II, & III autoimmune polyglandular syndromes, Polymyalgia rheumatica, Polymyositis, Postmyocardial infarction syndrome, Postpericardiotomy syndrome, Progesterone dermatitis, Primary biliary cirrhosis, Primary sclerosing cholangitis, Psoriasis, Psoriatic arthritis, Idiopathic pulmonary fibrosis, Pyoderma gangrenosum, Pure red cell aplasia, Raynauds phenomenon, Reactive Arthritis, Reflex sympathetic dystrophy, Reiter's syndrome, Relapsing polychondritis, Restless legs syndrome, Retroperitoneal fibrosis, Rheumatic fever, Rheumatoid arthritis, Sarcoidosis, Schmidt syndrome, Scleritis, Scleroderma, Sjogren's syndrome, Sperm & testicular autoimmunity, Stiff person syndrome, Subacute bacterial endocarditis (SBE), Susac's syndrome, Sympathetic ophthalmia, Takayasu's arteritis, Temporal arteritis/Giant cell arteritis, Thrombocytopenic purpura (TTP), Tolosa-Hunt syndrome, Transverse myelitis, Ulcerative colitis, Undifferentiated connective tissue disease (UCTD), Uveitis, Vasculitis, Vesiculobullous dermatosis, Vitiligo, and Wegener's granulomatosis (now termed Granulomatosis with Polyangiitis (GPA).

Various kidney diseases may be treated with pharmaceutical compositions, biocircuits, biocircuit components, effector modules including their SREs or payloads of the present invention. As a non-limiting example, the kidney disease Abderhalden-Kaufmann-Lignac syndrome (Nephropathic Cystinosis), Abdominal Compartment Syndrome, Acute Kidney Failure/Acute Kidney Injury, Acute Lobar Nephronia, Acute Phosphate Nephropathy, Acute Tubular Necrosis, Adenine Phosphoribosyltransferase Deficiency, Adenovirus Nephritis, Alport Syndrome, Amyloidosis, ANCA Vasculitis Related to Endocarditis and Other Infections, Angiomyolipoma, Analgesic Nephropathy, Anorexia Nervosa and Kidney Disease, Angiotensin Antibodies and Focal Segmental Glomerulosclerosis, Antiphospholipid Syndrome, Anti-TNF-α Therapy-related Glomerulonephritis, APOL1 Mutations, Apparent Mineralocorticoid Excess Syndrome, Aristolochic Acid Nephropathy, Chinese Herbal Nephropathy, Balkan Endemic Nephropathy, Bartter Syndrome, Beeturia, P3-Thalassemia Renal Disease, Bile Cast Nephropathy, BK Polyoma Virus Nephropathy in the Native Kidney, Bladder Rupture, Bladder Sphincter Dyssynergia, Bladder Tamponade, Border-Crossers' Nephropathy, Bourbon Virus and Acute Kidney Injury, Burnt Sugarcane Harvesting and Acute Renal Dysfunction, Byetta and Renal Failure, Clq Nephropathy, Cannabinoid Hyperemesis Acute Renal Failure, Cardiorenal syndrome, Carfilzomib-Indiced Renal Injury, CFHR5 nephropathy, Charcot-Marie-Tooth Disease with Glomerulopathy, Cherry Concentrate and Acute Kidney Injury, Cholesterol Emboli, Churg-Strauss syndrome, Chyluria, Colistin Nephrotoxicity, Collagenofibrotic Glomerulopathy, Collapsing Glomerulopathy, Collapsing Glomerulopathy Related to CMV, Congenital Nephrotic Syndrome, Conorenal syndrome (Mainzer-Saldino Syndrome or Saldino-Mainzer Disease), Contrast Nephropathy, Copper Sulpfate Intoxication, Cortical Necrosis, Crizotinib-related Acute Kidney Injury, Cryoglobuinemia, Crystalglobulin-Induced Nephropathy, Crystal-Induced Acute Kidney injury, Cystic Kidney Disease, Acquired, Cystinuria, Dasatinib-Induced Nephrotic-Range Proteinuria, Dense Deposit Disease (MPGN Type 2), Dent Disease (X-linked Recessive Nephrolithiasis), Dialysis Disequilibrium Syndrome, Diabetes and Diabetic Kidney Disease, Diabetes Insipidus, Dietary Supplements and Renal Failure, Drugs of Abuse and Kidney Disease, Duplicated Ureter, EAST syndrome, Ebola and the Kidney, Ectopic Kidney, Ectopic Ureter, Edema, Swelling, Erdheim-Chester Disease, Fabry's Disease, Familial Hypocalciuric Hypercalcemia, Fanconi Syndrome, Fraser syndrome, Fibronectin Glomerulopathy, Fibrillary Glomerulonephritis and Immunotactoid Glomerulopathy, Fraley syndrome, Focal Segmental Glomerulosclerosis, Focal Sclerosis, Focal Glomerulosclerosis, Galloway Mowat syndrome, Giant Cell (Temporal) Arteritis with Kidney Involvement, Gestational Hypertension, Gitelman Syndrome, Glomerular Diseases, Glomerular Tubular Reflux, Glycosuria, Goodpasture Syndrome, Hair Dye Ingestion and Acute Kidney Injury, Hantavirus Infection Podocytopathy, Hematuria (Blood in Urine), Hemolytic Uremic Syndrome (HUS), Atypical Hemolytic Uremic Syndrome (aHUS), Hemophagocytic Syndrome, Hemorrhagic Cystitis, Hemorrhagic Fever with Renal Syndrome (HFRS, Hantavirus Renal Disease, Korean Hemorrhagic Fever, Epidemic Hemorrhagic Fever, Nephropathis Epidemica), Hemosiderosis related to Paroxysmal Nocturnal Hemoglobinuria and Hemolytic Anemia, Hepatic Glomerulopathy, Hepatic Veno-Occlusive Disease, Sinusoidal Obstruction Syndrome, Hepatitis C-Associated Renal Disease, Hepatorenal Syndrome, Herbal Supplements and Kidney Disease, High Blood Pressure and Kidney Disease, HIV-Associated Nephropathy (HIVAN), Horseshoe Kidney (Renal Fusion), Hunner's Ulcer, Hyperaldosteronism, Hypercalcemia, Hyperkalemia, Hypermagnesemia, Hypernatremia, Hyperoxaluria, Hyperphosphatemia, Hypocalcemia, Hypokalemia, Hypokalemia-induced renal dysfunction, Hypokalemic Periodic Paralysis, Hypomagnesemia, Hyponatremia, Hypophosphatemia, IgA Nephropathy, IgG4 Nephropathy, Interstitial Cystitis, Painful Bladder Syndrome (Questionnaire), Interstitial Nephritis, Ivemark's syndrome, Ketamine-Associated Bladder Dysfunction, Kidney Stones, Nephrolithiasis, Kombucha Tea Toxicity, Lead Nephropathy and Lead-Related Nephrotoxicity, Leptospirosis Renal Disease, Light Chain Deposition Disease, Monoclonal Immunoglobulin Deposition Disease, Liddle Syndrome, Lightwood-Albright Syndrome, Lipoprotein Glomerulopathy, Lithium Nephrotoxicity, LMX1B Mutations Cause Hereditary FSGS, Loin Pain Hematuria, Lupus, Systemic Lupus Erythematosis, Lupus Kidney Disease, Lupus Nephritis, Lupus Nephritis with Antineutrophil Cytoplasmic Antibody Seropositivity, Lyme Disease-Associated Glomerulonephritis, Malarial Nephropathy, Malignancy-Associated Renal Disease, Malignant Hypertension, Malakoplakia, Meatal Stenosis, Medullary Cystic Kidney Disease, Medullary Sponge Kidney, Megaureter, Melamine Toxicity and the Kidney, Membranoproliferative Glomerulonephritis, Membranous Nephropathy, MesoAmerican Nephropathy, Metabolic Acidosis, Metabolic Alkalosis, Methotrexate-related Renal Failure, Microscopic Polyangiitis, Milk-alkalai syndrome, Minimal Change Disease, MDMA (Molly; Ecstacy; 3,4-Methylenedioxymethamphetamine) and Kidney Failure, Multicystic dysplastic kidney, Multiple Myeloma, Myeloproliferative Neoplasms and Glomerulopathy, Nail-patella Syndrome, Nephrocalcinosis, Nephrogenic Systemic Fibrosis, Nephroptosis (Floating Kidney, Renal Ptosis), Nephrotic Syndrome, Neurogenic Bladder, Nodular Glomerulosclerosis, Non-Gonococcal Urethritis, Nutcracker syndrome, Orofaciodigital Syndrome, Orotic Aciduria, Orthostatic Hypotension, Orthostatic Proteinuria, Osmotic Diuresis, Ovarian Hyperstimulation Syndrome, Page Kidney, Papillary Necrosis, Papillorenal Syndrome (Renal-Coloboma Syndrome, Isolated Renal Hypoplasia), Parvovirus B 19 and the Kidney, The Peritoneal-Renal Syndrome, Posterior Urethral Valve, Post-infectious Glomerulonephritis, Post-streptococcal Glomerulonephritis, Polyarteritis Nodosa, Polycystic Kidney Disease, Posterior Urethral Valves, Preeclampsia, Propofol infusion syndrome, Proliferative Glomerulonephritis with Monoclonal IgG Deposits (Nasr Disease), Propolis (Honeybee Resin) Related Renal Failure, Proteinuria (Protein in Urine), Pseudohyperaldosteronism, Pseudohypobicarbonatemia, Pseudohypoparathyroidism, Pulmonary-Renal Syndrome, Pyelonephritis (Kidney Infection), Pyonephrosis, Radiation Nephropathy, Ranolazine and the Kidney, Refeeding syndrome, Reflux Nephropathy, Rapidly Progressive Glomerulonephritis, Renal Abscess, Peripnephric Abscess, Renal Agenesis, Renal Arcuate Vein Microthrombi-Associated Acute Kidney Injury, Renal Artery Aneurysm, Renal Artery Stenosis, Renal Cell Cancer, Renal Cyst, Renal Hypouricemia with Exercise-induced Acute Renal Failure, Renal Infarction, Renal Osteodystrophy, Renal Tubular Acidosis, Renin Secreting Tumors (Juxtaglomerular Cell Tumor), Reset Osmostat, Retrocaval Ureter, Retroperitoneal Fibrosis, Rhabdomyolysis, Rhabdomyolysis related to Bariatric surgery, Rheumatoid Arthritis-Associated Renal Disease, Sarcoidosis Renal Disease, Salt Wasting, Renal and Cerebral, Schistosomiasis and Glomerular Disease, Schimke immuno-osseous dysplasia, Scleroderma Renal Crisis, Serpentine Fibula-Polycystic Kidney Syndrome, Exner Syndrome, Sickle Cell Nephropathy, Silica Exposure and Chronic Kidney Disease, Sri Lankan Farmers' Kidney Disease, Sjögren's Syndrome and Renal Disease, Synthetic Cannabinoid Use and Acute Kidney Injury, Kidney Disease Following Hematopoietic Cell Transplantation, Kidney Disease Related to Stem Cell Transplantation, Thin Basement Membrane Disease, Benign Familial Hematuria, Trigonitis, Tuberculosis, Genitourinary, Tuberous Sclerosis, Tubular Dysgenesis, Immune Complex Tubulointerstitial Nephritis Due to Autoantibodies to the Proximal Tubule Brush Border, Tumor Lysis Syndrome, Uremia, Uremic Optic Neuropathy, Ureteritis Cystica, Ureterocele, Urethral Caruncle, Urethral Stricture, Urinary Incontinence, Urinary Tract Infection, Urinary Tract Obstruction, Vesicointestinal Fistula, Vesicoureteral Reflux, Volatile Anesthetics and Acute Kidney Injury, Von Hippel-Lindau Disease, Waldenstrom's Macroglobulinemic Glomerulonephritis, Warfarin-Related Nephropathy, Wasp Stings and Acute Kidney Injury, Wegener's Granulomatosis, Granulomatosis with Polyangiitis, West Nile Virus and Chronic Kidney Disease, and Wunderlich syndrome.

Various cardiovascular diseases may be treated with pharmaceutical compositions, biocircuits, biocircuit components, effector modules including their SREs or payloads of the present invention. As a non-limiting example, the cardiovascular disease may be Ischemic heart disease also known as coronary artery disease, Cerebrovascular disease (Stroke), Peripheral vascular disease, Heart failure, Rheumatic heart disease, and Congenital heart disease.

Various antibody deficiencies may be treated with pharmaceutical compositions, biocircuits, biocircuit components, effector modules including their SREs or payloads of the present invention. As a non-limiting example, the antibody deficiencies may be X-Linked Agammaglobulinemia (XLA), Autosomal Recessive Agammaglobulinemia (ARA), Common Variable Immune Deficiency (CVID), IgG (IgG1, IgG2, IgG3 and IgG4) Subclass Deficiency, Selective IgA Deficiency, Specific Antibody Deficiency (SAD), Transient Hypogammaglobulinemia of Infancy, Antibody Deficiency with Normal or Elevated Immunoglobulins, Selective IgM Deficiency, Immunodeficiency with Thymoma (Good's Syndrome), Transcobalamin II Deficiency, Warts, Hypogammaglobulinemia, Infection, Myelokathexis (WHIM) Syndrome, Drug-Induced Antibody Deficiency, Kappa Chain Deficiency, Heavy Chain Deficiencies, Post-Meiotic Segregation (PMS2) Disorder, and Unspecified Hypogammaglobulinemia.

Various ocular diseases may be treated with pharmaceutical compositions, biocircuits, biocircuit components, effector modules including their SREs or payloads of the present invention. As a non-limiting example, the ocular disease may be thyroid eye disease (TED), Graves' disease (GD) and orbitopathy, Retina Degeneration, Cataract, optic atrophy, macular degeneration, Leber congenital amaurosis, retinal degeneration, cone-rod dystrophy, Usher syndrome, leopard syndrome, photophobia, and photoaversion.

Various neurological diseases may be treated with pharmaceutical compositions, biocircuits, biocircuit components, effector modules including their SREs or payloads of the present invention. As a non-limiting example, the neurological disease may be Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adie's Syndrome, Adrenoleukodystrophy, Agenesis of the Corpus Callosum, Agnosia, Aicardi Syndrome, Aicardi-Goutieres Syndrome Disorder, AIDS-Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Arnold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosomal Dominant Arteriopathy with Sub-cortical Infarcts and Leukoencephalopathy (CADASIL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavernous Malformation, Cerebral Gigantism, Cerebral Hypoxia, Cerebral Palsy, Cerebro-Oculo-Facio-Skeletal Syndrome (COFS), Charcot-Marie-Tooth Disease, Chiari Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt-Jakob Disease, Cumulative Trauma Disorders, Cushing's Syndrome, Cytomegalic Inclusion Body Disease, Cytomegalovirus Infection, Dancing Eyes-Dancing Feet Syndrome, Dandy-Walker Syndrome, Dawson Disease, De Morsier's Syndrome, Dejerine-Klumpke Palsy, Dementia, Dementia-Multi-Infarct, Dementia-Semantic, Dementia-Subcortical, Dementia With Lewy Bodies, Dentate Cerebellar Ataxia, Dentatorubral Atrophy, Dermatomyositis, Developmental Dyspraxia, Devic's Syndrome, Diabetic Neuropathy, Diffuse Sclerosis, Dravet Syndrome, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Angiomatosis, Epilepsy, Epileptic Hemiplegia, Erb's Palsy, Erb-Duchenne and Dejerine-Klumpke Palsies, Essential Tremor, Extrapontine Myelinolysis, Fabry Disease, Fahr's Syndrome, Fainting, Familial Dysautonomia, Familial Hemangioma, Familial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy Infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, Globoid Cell Leukodystrophy, Glossopharyngeal Neuralgia, Glycogen Storage Disease, Guillain-Barre Syndrome, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-1 Associated Myelopathy, Hughes Syndrome, Huntington's Disease, Hydranencephaly, Hydrocephalus, Hydrocephalus-Normal Pressure, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Sayre Syndrome, Kennedy's Disease, Kinsbourne syndrome, Kleine-Levin Syndrome, Klippel-Feil Syndrome, Klippel-Trenaunay Syndrome (KTS), Kliver-Bucy Syndrome, Korsakoffs Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-In Syndrome, Lou Gehrig's Disease, Lupus-Neurological Sequelae, Lyme Disease-Neurological Complications, Machado-Joseph Disease, Macrencephaly, Megalencephaly, Melkersson-Rosenthal Syndrome, Meningitis, Meningitis and Encephalitis, Menkes Disease, Meralgia Paresthetica, Metachromatic Leukodystrophy, Microcephaly, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidosis, Multi-Infarct Dementia, Multifocal Motor Neuropathy, Multiple Sclerosis, Multiple System Atrophy, Multiple System Atrophy with Orthostatic Hypotension, Muscular Dystrophy, Myasthenia-Congenital, Myasthenia Gravis, Myelinoclastic Diffuse Sclerosis, Myoclonic Encephalopathy of Infants, Myoclonus, Myopathy, Myopathy-Congenital, Myopathy-Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscinosis, Neuronal Migration Disorders, Neuropathy-Hereditary, Neurosarcoidosis, Neurosyphilis, Neurotoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain-Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Pinched Nerve, *Piriformis* Syndrome, Pituitary Tumors, Polymyositis, Pompe Disease, Porencephaly, Post-Polio Syndrome, Postherpetic Neuralgia, Post infectious Encephalomyelitis, Postural Hypotension, Postural Orthostatic Tachycardia Syndrome, Postural Tachycardia Syndrome, Primary Dentatum Atrophy, Primary Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasmosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease-Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjögren's Syndrome, Sleep Apnea, Sleeping Sickness, Sotos Syndrome, Spasticity, Spina *Bifida*, Spinal Cord Infarction, Spinal Cord Injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syringomyelia, Systemic Lupus Erythematosus, Tabes *Dorsalis*, Tardive Dyskinesia, Tarlov Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VHL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome, Wilson Disease, Wolman's Disease, X-Linked Spinal and Bulbar Muscular Atrophy.

Various psychological disorders may be treated with pharmaceutical compositions, biocircuits, biocircuit components, effector modules including their SREs or payloads of the present invention. As a non-limiting example, the psychological disorders may be Aboulia, Absence epilepsy, Acute stress Disorder, Adjustment Disorders, Adverse effects of medication NOS, Age related cognitive decline, Agoraphobia, Alcohol Addiction, Alzheimer's Disease, Amnesia (also known as Amnestic Disorder), Amphetamine Addiction, Anorexia Nervosa, Anterograde amnesia, Antisocial personality disorder (also known as Sociopathy), Anxiety Disorder (Also known as Generalized Anxiety Disorder), Anxiolytic related disorders, Asperger's Syndrome (now part of Autism Spectrum Disorder), Attention Deficit Disorder (Also known as ADD), Attention Deficit Hyperactivity Disorder (Also known as ADHD), Autism Spectrum Disorder (also known as Autism), Autophagia, Avoidant Personality Disorder, Barbiturate related disorders, Benzodiazepine related disorders, Bereavement, Bibliomania, Binge Eating Disorder, Bipolar disorder (also known as Manic Depression, includes Bipolar I and Bipolar II), Body Dysmorphic Disorder, Borderline intellectual functioning, Borderline Personality Disorder, Breathing-Related Sleep Disorder, Brief Psychotic Disorder, Bruxism, Bulimia Nervosa, Caffeine Addiction, *Cannabis* Addiction, Catatonic disorder, Catatonic schizophrenia, Childhood amnesia, Childhood Disintegrative Disorder (now part of Autism Spectrum Disorder), Childhood Onset Fluency Disorder (formerly known as Stuttering), Circadian Rhythm Disorders, Claustrophobia, Cocaine related disorders, Communication disorder, Conduct Disorder, Conversion Disorder, Cotard delusion, Cyclothymia (also known as Cyclothymic Disorder), Delerium, Delusional Disorder, dementia, Dependent Personality Disorder (also known as Asthenic Personality Disorder), Depersonalization disorder (now known as Depersonalization/Derealization Disorder), Depression (also known as Major Depressive Disorder), Depressive personality disorder, Derealization disorder (now known as Depersonalization/Derealization Disorder), Dermotillomania, Desynchronosis, Developmental coordination disorder, Diogenes Syndrome, Disorder of written expression, Dispareunia, Dissocial Personality Disorder, Dissociative Amnesia, Dissociative Fugue, Dissociative Identity Disorder (formerly known as Multiple Personality Disorder), Down syndrome, Dyslexia, Dyspareunia, Dysthymia (now known as Persistent Depressive Disorder), Eating disorder NOS, Ekbom's Syndrome (Delusional Parasitosis), Emotionally unstable personality disorder, Encopresis, Enuresis (bedwetting), Erotomania, Exhibitionistic Disorder, Expressive language disorder, Factitious Disorder, Female Sexual Disorders, Fetishistic Disorder, Folie à deux, Fregoli delusion, Frotteuristic Disorder, Fugue State, Ganser syndrome, Gambling Addiction, Gender Dysphoria (formerly known as Gender Identity Disorder), Generalized Anxiety Disorder, General adaptation syndrome, Grandiose delusions, Hallucinogen Addiction, Haltlose personality disorder, Histrionic Personality Disorder, Primary hypersomnia, Huntington's Disease, Hypoactive sexual desire disorder, Hypochondriasis, Hypomania, Hyperkinetic syndrome, Hypersomnia, Hysteria, Impulse control disorder, Impulse control disorder NOS, Inhalant Addiction, Insomnia, Intellectual Development Disorder, Intermittent Explosive Disorder, Joubert syndrome, Kleptomania, Korsakoff's syndrome, Lacunar amnesia, Language Disorder, Learning Disorders, Major Depression (also known as Major Depressive Disorder), major depressive disorder, Male Sexual Disorders, Malingering, Mathematics disorder, Medication-related disorder, Melancholia, Mental Retardation (now known as Intellectual Development Disorder), Misophonia, Morbid jealousy, Multiple Personality Disorder (now known as Dissociative Identity Disorder), Munchausen Syndrome, Munchausen by Proxy, Narcissistic Personality Disorder, Narcolepsy, Neglect of child, Neurocognitive Disorder (formerly known as Dementia), Neuroleptic-related disorder, Nightmare Disorder, Non Rapid Eye Movement, Obsessive-Compulsive Disorder, Obsessive-Compulsive Personality Disorder (also known as Anankastic Personality Disorder), Oneirophrenia, Onychophagia, Opioid Addiction, Oppositional Defiant Disorder, Orthorexia (ON), Pain disorder, Panic attacks, Panic Disorder, Paranoid Personality Disorder, Parkinson's Disease, Partner relational problem, Passive-aggressive personality disorder, Pathological gambling, Pedophilic Disorder, Perfectionism, Persecutory delusion, Persistent Depressive Disorder (also known as Dysthymia), Personality change due to a general medical condition, Personality disorder, Pervasive developmental disorder (PDD), Phencyclidine related disorder, Phobic disorder, Phonological disorder, Physical abuse, Pica, Polysubstance related disorder, Postpartum Depression, Post-traumatic embitterment disorder (PTED), Post-Traumatic Stress Disorder, Premature ejaculation, Premenstrual Dysphoric Disorder, Psychogenic amnesia, Psychological factor affecting medical condition, Psychoneurotic personality disorder, Psychotic disorder, not otherwise specified, Pyromania, Reactive Attachment Disorder, Reading disorder, Recurrent brief depression, Relational disorder, REM Sleep Behavior Disorder, Restless Leg Syndrome, Retrograde amnesia, Retts Disorder (now part of Autism Spectrum Disorder), Rumination syndrome, Sadistic personality disorder, Schizoaffective Disorder, Schizoid Personality Disorder, Schizophrenia, Schizophreniform disorder, Schizotypal Personality Disorder, Seasonal Affective Disorder, Sedative, Hypnotic, or Anxiolytic Addiction, Selective Mutism, Self-defeating personality disorder, Separation Anxiety Disorder, Sexual Disorders Female, Sexual Disorders Male, Sexual Addiction, Sexual Masochism Disorder, Sexual Sadism Disorder, Shared Psychotic Disorder, Sleep Arousal Disorders, Sleep Paralysis, Sleep Terror Disorder (now part of Nightmare Disorder, Social Anxiety Disorder, Somatization Disorder, Specific Phobias, Stendhal syndrome, Stereotypic movement disorder, Stimulant Addiction, Stuttering (now known as Childhood Onset Fluency Disorder), Substance related disorder, Tardive dyskinesia, Tobacco Addiction, Tourettes Syndrome, Transient tic disorder, Transient global amnesia, Transvestic Disorder, Trichotillomania, Undifferentiated Somatoform Disorder, Vaginismus, and Voyeuristic Disorder.

Various lung diseases may be treated with pharmaceutical compositions, biocircuits, biocircuit components, effector modules including their SREs or payloads of the present invention. As a non-limiting example, the lung diseases may be Asbestosis, Asthma, Bronchiectasis, Bronchitis, Chronic Cough, Chronic Obstructive Pulmonary Disease (COPD), Croup, Cystic Fibrosis, Hantavirus, Idiopathic Pulmonary Fibrosis, Pertussis, Pleurisy, Pneumonia, Pulmonary Embolism, Pulmonary Hypertension, Sarcoidosis, Sleep Apnea, Spirometry, Sudden Infant Death Syndrome (SIDS), Tuberculosis, Alagille Syndrome, Autoimmune Hepatitis, Biliary Atresia, Cirrhosis, ERCP (Endoscopic Retrograde Cholangiopancreatography), and Hemochromatosis. Nonalcoholic Steatohepatitis, *Porphyria*, Primary Biliary Cirrhosis, Primary Sclerosing Cholangitis.

Various bone diseases may be treated with pharmaceutical compositions, biocircuits, biocircuit components, effector modules including their SREs or payloads of the present invention. As a non-limiting example, the bone diseases may be osteoporosis, neurofibromatosis, osteogenesis imperfecta (OI), rickets, osteosarcoma, achondroplasia, fracture, osteomyelitis, Ewing tumor of bone, osteomalacia, hip dysplasia, Paget disease of bone, marble bone disease, osteochondroma, bone cancer, bone disease, osteochondrosis, osteoma, fibrous dysplasia, cleidocranial dysostosis, osteoclastoma, bone cyst, metabolic bone disease, melorheostosis, callus, Caffey syndrome, and mandibulofacial dysostosis.

Various blood diseases may be treated with pharmaceutical compositions, biocircuits, biocircuit components, effector modules including their SREs or payloads of the present invention. As a non-limiting example, the blood diseases may be Anemia and CKD (for health care professionals), Aplastic Anemia and Myelodysplastic Syndromes, Deep Vein Thrombosis, Hemochromatosis, Hemophilia, Henoch- Schonlein Purpura, Idiopathic Thrombocytopenic Purpura, Iron-Deficiency Anemia, Pernicious Anemia, Pulmonary Embolism, Sickle Cell Anemia, Sickle Cell Trait and Other Hemoglobinopathies, Thalassemia, Thrombotic Thrombocytopenic Purpura, and Von Willebrand Disease.

8. Gene Editing

The CRISPR-Cas9 system is a novel genome editing system which has been rapidly developed and implemented in a multitude of model organisms and cell types, and supplants other genome editing technologies, such as TALENs and ZFNs. CRISPRs are sequence motifs are present in bacterial and archaeal genomes, and are composed of short (about 24-48 nucleotide) direct repeats separated by similarly sized, unique spacers (Grissa et al. BMC *Bioinformatics* 8, 172 (2007). They are generally flanked by a set of CRISPR-associated (Cas) protein-coding genes that are required for CRISPR maintenance and function (Barrangou et al., *Science* 315, 1709 (2007), Brouns et al., *Science* 321, 960 (2008), Haft et al. *PLoS Comput Biol* 1, e60 (2005). CRISPR-Cas systems provide adaptive immunity against invasive genetic elements (e.g., viruses, phages and plasmids) (Horvath and Barrangou, Science, 2010, 327: 167-170; Bhaya et al., Annu. Rev. Genet., 2011, 45: 273-297; and Brrangou R, RNA, 2013, 4: 267-278). Three different types of CRISPR-Cas systems have been classified in bacteria and the type II CRISPR-Cas system is most studied. In the bacterial Type II CRISPR-Cas system, small CRISPR RNAs (crRNAs) processed from the pre-repeat-spacer transcript (pre-crRNA) in the presence of a trans-activating RNA (tracrRNA)/Cas9 can form a duplex with the tracrRNA/Cas9 complex. The mature complex is recruited to a target double strand DNA sequence that is complementary to the spacer sequence in the tracrRNA: crRNA duplex to cleave the target DNA by Cas9 endonuclease (Garneau et al., Nature, 2010, 468: 67-71; Jinek et al., Science, 2012, 337: 816-821; Gasiunas et al., Proc. Natl Acad. Sci. USA., 109: E2579-2586; and Haurwitz et al., Science, 2010, 329: 1355-1358). Target recognition and cleavage by the crRNA: tracrRNA/Cas9 complex in the type II CRISPR-CAS system not only requires a sequence in the tracrRNA: crRNA duplex that is a complementary to the target sequence (also called "protospacer" sequence) but also requires a protospacer adjacent motif (PAM) sequence located 3' end of the protospacer sequence of a target polynucleotide. The PAM motif can vary between different CRISPR-Cas systems.

CRISPR-Cas9 systems have been developed and modified for use in genetic editing and prove to be a high effective and specific technology for editing a nucleic acid sequence even in eukaryotic cells. Many researchers disclosed various modifications to the bacterial CRISPR-Cas systems and demonstrated that CRISPR-Cas systems can be used to manipulate a nucleic acid in a cell, such as in a mammalian cell and in a plant cell. Representative references include U.S. Pat. Nos. 8,993,233; 8,999,641; 8,945,839; 8,932,814; 8,906, 616; 8,895,308; 8,889,418; 8,889,356; 8,871,445; 8,865,406; 8,771,945; and 8,697,359; US patent publication NOs. 20150031134; 20150203872; 20150218253; 20150176013; 20150191744; 20150071889; 20150067922; and 20150167000; each of which is incorporated herein by reference in their entirety.

However, controlling the effects and activity of the CRISPR-Cas system (e.g., guide RNA and nuclease) has been challenging and often can be problematic.

The biocircuits of the present invention and/or any of their components may be utilized in regulating or tuning the CRISPR/Cas9 system in order to optimize its utility.

In some embodiments, the payloads of the effector modules of the invention may include alternative isoforms or orthologs of the Cas9 enzyme.

The most commonly used Cas9 is derived from *Streptococcus pyogenes* and the RuvC domain can be inactivated by a D10A mutation and the HNH domain can be inactivated by an H840A mutation.

In addition to Cas9 derived from *S. pyogenes*, other RNA guided endonucleases (RGEN) may also be used for programmable genome editing. Cas9 sequences have been identified in more than 600 bacterial strains. Though Cas9 family shows high diversity of amino acid sequences and protein sizes, All Cas9 proteins share a common architecture with a central HNH nuclease domain and a split RuvC/RHase H domain. Examples of Cas9 orthologs from other bacterial strains including but not limited to, *Cas proteins identified in Acaryochloris marina* MBIC 11017; *Acetohalobium arabaticum* DSM 5501; *Acidithiobacillus caldus*; *Acidithiobacillus ferrooxidans* ATCC 23270; *Alicyclobacillus acidocaldarius* LAA1; *Alicyclobacillus acidocaldarius* subsp. *acidocaldarius* DSM 446; *Allochromatium vinosum* DSM 180; *Ammonifex degensii* KC4; *Anabaena variabilis* ATCC 29413; *Arthrospira maxima* CS-328; *Arthrospira platensis* str. *Paraca*; *Arthrospira* sp. PCC 8005; *Bacillus pseudomycoides* DSM 12442; *Bacillus selenitireducens* MLS10; *Burkholderiales bacterium* 1_1_47; *Caldicellulosiruptor becscii* DSM 6725; *Candidatus Desulforudis audaxviator* MP104C; *Caldicellulosiruptor hydrothermalis*108; *Clostridium* phage c-st; *Clostridium botulinum* A3 str. Loch Maree; *Clostridium botulinum* Ba4 str. 657; *Clostridium difficile* QCD-63q42; *Crocosphaera watsonii* WH 8501; *Cyanothece* sp. ATCC 51142; *Cyanothece* sp. CCY0110; *Cyanothece* sp. PCC 7424; *Cyanothece* sp. PCC 7822; *Exiguobacterium sibiricum* 255-15; *Finegoldia magna* ATCC 29328; *Ktedonobacter racemifer* DSM 44963; *Lactobacillus delbrueckii* subsp. *bulgaricus* PB2003/044-T3-4; *Lactobacillus salivarius* ATCC 11741; *Listeria innocua*; *Lyngbya* sp. PCC 8106; *Marinobacter* sp. ELB17; *Methanohalobium evestigatum* Z-7303; *Microcystis* phage Ma-LMM01; *Microcystis aeruginosa* NIES-843; *Microscilla marina* ATCC 23134; *Microcoleus chthonoplastes* PCC 7420; *Neisseria meningitidis*; *Nitrosococcus halophilus* Nc4; *Nocardiopsis dassonvillei* subsp. *dassonvillei* DSM 43111; *Nodularia spumigena* CCY9414; *Nostoc* sp. PCC 7120; *Oscillatoria* sp. PCC 6506; *Pelotomaculum thermopropionicum* SI; *Petrotoga mobilis* SJ95; *Polaromonas naphthalenivorans* CJ2; *Polaromonas* sp. JS666; *Pseudoalteromonas haloplanktis* TAC125; *Streptomyces pristinaespiralis* ATCC 25486; *Streptomyces pristinaespiralis* ATCC 25486; *Streptococcus thermophilus*; *Streptomyces viridochromogenes* DSM 40736; *Streptosporangium roseum* DSM 43021; *Synechococcus* sp. PCC 7335; and *Thermosipho africanus* TCF52B (Chylinski et al., *RNA Biol.*, 2013; 10(5): 726-737).

In addition to Cas9 orthologs, other Cas9 variants such as fusion proteins of inactive dCas9 and effector domains with different functions may be served as a platform for genetic modulation. Any of the foregoing enzymes may be useful in the present invention.

9. Stem Cell Applications

The biocircuits of the present invention and/or any of their components may be utilized in the regulated reprogramming of cells, stem cell engraftment or other application where controlled or tunable expression of such reprogramming factors are useful.

The biocircuits of the present invention may be used in reprogramming cells including stem cells or induced stem cells. Induction of induced pluripotent stem cells (iPSC) was first achieved by Takahashi and Yamanaka (*Cell,* 2006. 126(4):663-76; herein incorporated by reference in its entirety) using viral vectors to express KLF4, c-MYC, OCT4 and SOX2 otherwise collectively known as KMOS.

Excisable lentiviral and transposon vectors, repeated application of transient plasmid, episomal and adenovirus vectors have also been used to try to derive iPSC (Chang, C.-W., et al., *Stem Cells,* 2009. 27(5):1042-1049; Kaji, K., et al., *Nature,* 2009. 458(7239):771-5; Okita, K., et al., *Science,* 2008. 322(5903):949-53; Stadtfeld, M., et al., *Science,* 2008. 322(5903):945-9; Woltjen, K., et al., *Nature,* 2009; Yu, J., et al., *Science,* 2009:1172482; Fusaki, N., et al., *Proc Jpn Acad Ser B Phys Biol Sci,* 2009. 85(8):348-62; each of which is herein incorporated by reference in its entirety).

DNA-free methods to generate human iPSC has also been derived using serial protein transduction with recombinant proteins incorporating cell-penetrating peptide moieties (Kim, D., et al., *Cell Stem Cell,* 2009. 4(6): 472-476; Zhou, H., et al., *Cell Stem Cell,* 2009. 4(5):381-4; each of which is herein incorporated by reference in its entirety), and infectious transgene delivery using the Sendai virus (Fusaki, N., et al., *Proc Jpn Acad Ser B Phys Biol Sci,* 2009. 85(8): p. 348-62; herein incorporated by reference in its entirety).

The effector modules of the present invention may include a payload comprising any of the genes including, but not limited to, OCT such as OCT4, SOX such as SOX1, SOX2, SOX3, SOX15 and SOX18, NANOG, KLF such as KLF1, KLF2, KLF4 and KLF5, MYC such as c-MYC and n-MYC, REM2, TERT and LIN28 and variants thereof in support of reprogramming cells. Sequences of such reprogramming factors are taught in for example International Application PCT/US2013/074560, the contents of which are incorporated herein by reference in their entirety.

IV. Dosing and Administrations

The present invention provides methods comprising administering any one or more compositions for immunotherapy to a subject in need thereof. These may be administered to a subject using any amount and any route of administration effective for preventing or treating a clinical condition such as cancer, infection diseases and other immunodeficient diseases.

Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, or prophylactically effective dose level for any particular patient will depend upon a variety of factors including the disorder being treated and the severity of the disorder; the activity of the specific compound employed; the specific composition employed; the age, body weight, general health, sex and diet of the patient; the time of administration, route of administration, previous or concurrent therapeutic interventions and rate of excretion of the specific compound employed; the duration of the treatment; drugs used in combination or coincidental with the specific compound employed; and like factors well known in the medical arts.

The destabilizing domains (DDs), effector modules and biocircuit systems of the invention and compositions comprising the same, may be administered by any route to achieve a therapeutically effective outcome.

These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electroosmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna *magna* cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal.

In some embodiments, compositions of the present invention, may be administered by any of the methods of administration taught in the copending commonly owned U.S. Provisional Patent Application No. 62/320,864 filed on Apr. 11, 2016 or in U.S. Provisional Application No. 62/466,596 filed Mar. 3, 2017 and the International Publication WO2017/180587, the contents of each of which are incorporated herein by reference in their entirety.

Kits and Applications

The also provides a kit comprising any of the polynucleotides or expression vectors described herein.

The present invention includes a variety of kits for conveniently and/or effectively carrying out methods of the present invention. Typically, kits will comprise sufficient amounts and/or numbers of components to allow a user to perform one or multiple treatments of a subject(s) and/or to perform one or multiple experiments.

In one embodiment, the present invention provides kits for inhibiting genes in vitro or in vivo, comprising a biocircuit of the present invention or a combination of biocircuits of the present invention, optionally in combination with any other suitable active agents.

The kit may further comprise packaging and instructions and/or a delivery agent to form a formulation composition. The delivery agent may comprise, for example, saline, a buffered solution.

In additional embodiments, assay screening kits are provided. The kit includes a container for the screening assay. An instruction for the use of the assay and the information about the screening method are to be included in the kit.

In some embodiments, the DDs, effector modules and biocircuit system and compositions of the invention may be used as research tools to investigate protein activity in a biological system such a cell and a subject. In other embodiments, the DDs, effector modules and biocircuit system and compositions of the invention may be used for treating a disease such as a cancer and a genetic disorder.

V. Delivery Modalities and/or Vector

Vectors

The present invention also provides vectors that package polynucleotides of the invention encoding biocircuits, effector modules, SREs (DDs) and payload constructs, and combinations thereof. Vectors of the present invention may also be used to deliver the packaged polynucleotides to a cell, a local tissue site or a subject. These vectors may be of any kind, including DNA vectors, RNA vectors, plasmids, viral vectors and particles. Viral vector technology is well known and described in Sambrook et al. (2001, Molecular Cloning: A Laboratory Manual, Cold Spring Harbor Laboratory, New York). Viruses, which are useful as vectors include, but are not limited to lentiviral vectors, adenoviral vectors, adeno-associated viral (AAV) vectors, herpes simplex viral vectors, retroviral vectors, oncolytic viruses, and the like.

In general, vectors contain an origin of replication functional in at least one organism, a promoter sequence and convenient restriction endonuclease site, and one or more selectable markers e.g. a drug resistance gene.

As used herein a promoter is defined as a DNA sequence recognized by transcription machinery of the cell, required to initiate specific transcription of the polynucleotide sequence of the present invention. Vectors can comprise native or non-native promoters operably linked to the polynucleotides of the invention. The promoters selected may be strong, weak, constitutive, inducible, tissue specific, development stage-specific, and/or organism specific. One example of a suitable promoter is the immediate early cytomegalovirus (CMV) promoter sequence. This promoter sequence is a strong constitutive promoter sequence capable of driving high levels of expression of polynucleotide sequence that is operatively linked to it. Another example of a preferred promoter is Elongation Growth Factor-1. Alpha (EF-1. alpha). Other constitutive promoters may also be used, including, but not limited to simian virus 40 (SV40), mouse mammary tumor virus (MMTV), human immunodeficiency virus (HIV), long terminal repeat (LTR), promoter, an avian leukemia virus promoter, an Epstein-Barr virus immediate early promoter, a Rous sarcoma virus promoter as well as human gene promoters including, but not limited to the phosphoglycerate kinase (PGK) promoter, actin promoter, the myosin promoter, the hemoglobin promoter, the Ubiquitin C (Ubc) promoter, the human U6 small nuclear protein promoter and the creatine kinase promoter. In some instances, inducible promoters such as but not limited to metallothionine promoter, glucocorticoid promoter, a progesterone promoter, and a tetracycline promoter may be used. In some embodiments, the promoter may be selected from the following a CMV promoter, comprising a nucleotide sequence of SEQ ID NO. 3099, a PGK promoter, comprising a nucleotide sequence of SEQ ID NO. 3100, and an EF1a promoter, comprising a nucleotide sequence of SEQ ID NO. 3101, or SEQ ID NO. 3102.

In some embodiments, the optimal promoter may be selected based on its ability to achieve minimal expression of the SREs and payloads of the invention in the absence of the ligand and detectable expression in the presence of the ligand.

Additional promoter elements e.g. enhancers may be used to regulate the frequency of transcriptional initiation. Such regions may be located 10-100 base pairs upstream or downstream of the start site. In some instances, two or more promoter elements may be used to cooperatively or independently activate transcription.

In some embodiments, the recombinant expression vector may comprise regulatory sequences, such as transcription and translation initiation and termination codons, which are specific to the type of host cell into which the vector is to be introduced.

1. Lentiviral Vectors

In some embodiments, lentiviral vectors/particles may be used as vehicles and delivery modalities. Lentiviruses are subgroup of the Retroviridae family of viruses, named because reverse transcription of viral RNA genomes to DNA is required before integration into the host genome. As such, the most important features of lentiviral vehicles/particles are the integration of their genetic material into the genome of a target/host cell. Some examples of lentivirus include the Human Immunodeficiency Viruses: HIV-1 and HIV-2, the Simian Immunodeficiency Virus (SIV), feline immunodeficiency virus (FIV), bovine immunodeficiency virus (BIV), Jembrana Disease Virus (JDV), equine infectious anemia virus (EIAV), equine infectious anemia virus, visna-maedi and caprine arthritis encephalitis virus (CAEV).

Typically, lentiviral particles making up the gene delivery vehicle are replication defective on their own (also referred to as "self-inactivating"). Lentiviruses are able to infect both dividing and non-dividing cells by virtue of the entry mechanism through the intact host nuclear envelope (Naldini L et al., *Curr. Opin. Biotechnol*, 1998, 9: 457-463). Recombinant lentiviral vehicles/particles have been generated by multiply attenuating the HIV virulence genes, for example, the genes Env, Vif, Vpr, Vpu, Nef and Tat are deleted making the vector biologically safe. Correspondingly, lentiviral vehicles, for example, derived from HIV-1/HIV-2 can mediate the efficient delivery, integration and long-term expression of transgenes into non-dividing cells. As used herein, the term "recombinant" refers to a vector or other nucleic acid containing both lentiviral sequences and non-lentiviral retroviral sequences.

Lentiviral particles may be generated by co-expressing the virus packaging elements and the vector genome itself in a producer cell such as human HEK293T cells. These elements are usually provided in three (in second generation lentiviral systems) or four separate plasmids (in third generation lentiviral systems). The producer cells are co-transfected with plasmids that encode lentiviral components including the core (i.e. structural proteins) and enzymatic components of the virus, and the envelope protein(s) (referred to as the packaging systems), and a plasmid that encodes the genome including a foreign transgene, to be transferred to the target cell, the vehicle itself (also referred to as the transfer vector). In general, the plasmids or vectors are included in a producer cell line. The plasmids/vectors are introduced via transfection, transduction or infection into the producer cell line. Methods for transfection, transduction or infection are well known by those of skill in the art. As non-limiting example, the packaging and transfer constructs can be introduced into producer cell lines by calcium phosphate transfection, lipofection or electroporation, generally together with a dominant selectable marker, such as neo, DHFR, Gln synthetase or ADA, followed by selection in the presence of the appropriate drug and isolation of clones.

The producer cell produces recombinant viral particles that contain the foreign gene, for example, the effector module of the present invention. The recombinant viral particles are recovered from the culture media and titrated by standard methods used by those of skill in the art. The recombinant lentiviral vehicles can be used to infect target cells.

Cells that can be used to produce high-titer lentiviral particles may include, but are not limited to, HEK293T cells, 293G cells, STAR cells (Relander et al., *Mol. Ther.*, 2005, 11: 452-459), FreeStyle™ 293 Expression System (ThermoFisher, Waltham, Mass.), and other HEK293T-based producer cell lines (e.g., Stewart et al., *Hum Gene Ther.* 2011, 22(3):357-369; Lee et al., *Biotechnol Bioeng*, 2012, 10996): 1551-1560; Throm et al., *Blood.* 2009, 113(21): 5104-5110; the contents of each of which are incorporated herein by reference in their entirety).

In some aspects, the envelope proteins may be heterologous envelop proteins from other viruses, such as the G protein of vesicular stomatitis virus (VSV G) or baculoviral gp64 envelop proteins. The VSV-G glycoprotein may especially be chosen among species classified in the vesiculovirus genus: *Carajas virus* (CJSV), *Chandipura virus* (CHPV), *Cocal virus* (COCV), *Isfahan virus* (ISFV), *Maraba virus* (MARAV), *Piry virus* (PIRYV), *Vesicular stomatitis Alagoas virus* (VSAV), *Vesicular stomatitis Indiana virus* (VSIV) and *Vesicular stomatitis New Jersey virus* (VSNJV) and/or stains provisionally classified in the vesiculovirus genus as *Grass carp rhabdovirus, BeAn 157575 virus* (BeAn 157575), *Boteke virus* (BTKV), *Calchaqui virus* (CQIV), *Eel virus American* (EVA), *Gray Lodge virus* (GLOV), *Jurona virus* (JURY), *Klamath virus* (KLAV), *Kwatta virus* (KWAV), *La Joya virus* (LJV), *Malpais Spring virus* (MSPV), *Mount Elgon bat virus* (MEBV), *Perinet virus* (PERV), *Pike fry rhabdovirus* (PFRV), *Porton virus* (PORV), *Radi virus* (RADIV), *Spring viremia of carp virus* (SVCV), *Tupaia virus* (TUPV), *Ulcerative disease rhabdovirus* (UDRV) and *Yug Bogdanovac virus* (YBV). The gp64 or other baculoviral env protein can be derived from *Autographa californica* nucleopolyhedrovirus (AcMNPV), *Anagrapha falcifera* nuclear polyhedrosis virus, *Bombyx mori* nuclear polyhedrosis virus, *Choristoneura fumiferana* nucleopolyhedrovirus, *Orgyia pseudotsugata* single capsid nuclear polyhedrosis virus, *Epiphyas postvittana* nucleopolyhedrovirus, *Hyphantria cunea* nucleopolyhedrovirus, *Galleria mellonella* nuclear polyhedrosis virus, Dhori virus, Thogoto virus, *Antheraea pemyi* nucleopolyhedrovirus or Batken virus.

Additional elements provided in lentiviral particles may comprise retroviral LTR (long-terminal repeat) at either 5' or 3' terminus, a retroviral export element, optionally a lentiviral reverse response element (RRE), a promoter or active portion thereof, and a locus control region (LCR) or active portion thereof. Other elements include central polypurine tract (cPPT) sequence to improve transduction efficiency in non-dividing cells, Woodchuck Hepatitis Virus (WHP) Post-transcriptional Regulatory Element (WPRE) which enhances the expression of the transgene, and increases titer. The effector module is linked to the vector.

Methods for generating recombinant lentiviral particles are discussed in the art, for example, U.S. Pat. Nos. 8,846,385; 7,745,179; 7,629,153; 7,575,924; 7,179,903; and 6,808,905; the contents of each of which are incorporated herein by reference in their entirety.

Lentivirus vectors used may be selected from, but are not limited to pLVX, pLenti, pLenti6, pLJM1, FUGW, pWPXL, pWPI, pLenti CMV puro DEST, pLJM1-EGFP, pULTRA, pInducer20, pHIV-EGFP, pCW57.1, pTRPE, pELPS, pRRL, and pLionII.

Lentiviral vehicles known in the art may also be used (See, U.S. Pat. Nos. 9,260,725; 9,068,199; 9,023,646; 8,900,858; 8,748,169; 8,709,799; 8,420,104; 8,329,462; 8,076,106; 6,013,516; and 5,994,136; International Patent Publication NO. WO2012079000; the contents of each of which are incorporated herein by reference in their entirety).

2. Retroviral Vectors (γ-Retroviral Vectors)

In some embodiments, retroviral vectors may be used to package and deliver the biocircuits, biocircuit components, effector modules, SREs or payload constructs of the present invention. Retroviral vectors (RVs) allow the permanent integration of a transgene in target cells. In addition to lentiviral vectors based on complex HIV-1/2, retroviral vectors based on simple gamma-retroviruses have been widely used to deliver therapeutic genes and demonstrated clinically as one of the most efficient and powerful gene delivery systems capable of transducing a broad range of cell types. Example species of Gamma retroviruses include the murine leukemia viruses (MLVs) and the feline leukemia viruses (FeLV).

In some embodiments, gamma-retroviral vectors derived from a mammalian gamma-retrovirus such as murine leukemia viruses (MLVs), are recombinant. The MLV families of gamma retroviruses include the ecotropic, amphotropic, xenotropic and polytropic subfamilies. Ecotropic viruses are able to infect only murine cells using mCAT-1 receptor. Examples of ecotropic viruses are Moloney MLV and AKV.

Amphotropic viruses infect murine, human and other species through the Pit-2 receptor. One example of an amphotropic virus is the 4070A virus. Xenotropic and polytropic viruses utilize the same (Xpr1) receptor, but differ in their species tropism. Xenotropic viruses such as NZB-9-1 infect human and other species but not murine species, whereas polytropic viruses such as focus-forming viruses (MCF) infect murine, human and other species.

Gamma-retroviral vectors may be produced in packaging cells by co-transfecting the cells with several plasmids including one encoding the retroviral structural and enzymatic (gag-pol) polyprotein, one encoding the envelope (env) protein, and one encoding the vector mRNA comprising polynucleotide encoding the compositions of the present invention that is to be packaged in newly formed viral particles.

In some aspects, the recombinant gamma-retroviral vectors are pseudotyped with envelope proteins from other viruses. Envelope glycoproteins are incorporated in the outer lipid layer of the viral particles which can increase/alter the cell tropism. Exemplary envelop proteins include the gibbon ape leukemia virus envelope protein (GALV) or vesicular stomatitis virus G protein (VSV-G), or Simian endogenous retrovirus envelop protein, or Measles Virus H and F proteins, or Human immunodeficiency virus gp120 envelope protein, or cocal vesiculovirus envelop protein (See, e.g., U.S. application publication NO. 2012/164118; the contents of which are incorporated herein by reference in its entirety). In other aspects, envelope glycoproteins may be genetically modified to incorporate targeting/binding ligands into gamma-retroviral vectors, binding ligands including, but not limited to, peptide ligands, single chain antibodies and growth factors (Waehler et al., *Nat. Rev. Genet.* 2007, 8(8):573-587; the contents of which are incorporated herein by reference in its entirety). These engineered glycoproteins can retarget vectors to cells expressing their corresponding target moieties. In other aspects, a "molecular bridge" may be introduced to direct vectors to specific cells. The molecular bridge has dual specificities: one end can recognize viral glycoproteins, and the other end can bind to the molecular determinant on the target cell. Such molecular bridges, for example ligand-receptor, avidin-biotin, and chemical conjugations, monoclonal antibodies and engineered fusogenic proteins, can direct the attachment of viral vectors to target cells for transduction (Yang et al., *Biotechnol. Bioeng.,* 2008, 101(2): 357-368; and Maetzig et al., *Viruses,* 2011, 3, 677-713; the contents of each of which are incorporated herein by reference in their entirety).

In some embodiments, the recombinant gamma-retroviral vectors are self-inactivating (SIN) gammaretroviral vectors. The vectors are replication incompetent. SIN vectors may harbor a deletion within the 3' U3 region initially comprising enhancer/promoter activity. Furthermore, the 5' U3 region may be replaced with strong promoters (needed in the packaging cell line) derived from Cytomegalovirus or RSV, or an internal promoter of choice, and/or an enhancer element. The choice of the internal promoters may be made according to specific requirements of gene expression needed for a particular purpose of the invention.

In some embodiments, polynucleotides encoding the biocircuit, biocircuit components, effector module, SRE are inserted within the recombinant viral genome. The other components of the viral mRNA of a recombinant gamma-retroviral vector may be modified by insertion or removal of naturally occurring sequences (e.g., insertion of an IRES, insertion of a heterologous polynucleotide encoding a polypeptide or inhibitory nucleic acid of interest, shuffling of a more effective promoter from a different retrovirus or virus in place of the wild-type promoter and the like). In some examples, the recombinant gamma-retroviral vectors may comprise modified packaging signal, and/or primer binding site (PBS), and/or 5'-enhancer/promoter elements in the U3-region of the 5'-long terminal repeat (LTR), and/or 3'-SIN elements modified in the U3-region of the 3'-LTR. These modifications may increase the titers and the ability of infection.

Gamma retroviral vectors suitable for delivering biocircuit components, effector modules, SREs or payload constructs of the present invention may be selected from those disclosed in U.S. Pat. Nos. 8,828,718; 7,585,676; 7,351,585; U.S. application publication NO. 2007/048285; PCT application publication NOs. WO2010/113037; WO2014/121005; WO2015/056014; and EP Pat. NOs. EP1757702; EP1757703 (the contents of each of which are incorporated herein by reference in their entirety).

3. Adeno-Associated Viral Vectors (AAV)

In some embodiments, polynucleotides of present invention may be packaged into recombinant adeno-associated viral (rAAV) vectors. Such vectors or viral particles may be designed to utilize any of the known serotype capsids or combinations of serotype capsids. The serotype capsids may include capsids from any identified AAV serotypes and variants thereof, for example, AAV1, AAV2, AAV2G9, AAV3, AAV4, AAV4-4, AAV5, AAV6, AAV7, AAV8, AAV9, AAV10, AAV11, AAV12 and AAVrh10.

In one embodiment, the AAV serotype may be or have a sequence as described in United States Publication No. US20030138772, herein incorporated by reference in its entirety, such as, but not limited to, AAV1 (SEQ ID NO. 6 and 64 of US20030138772), AAV2 (SEQ ID NO. 7 and 70 of US20030138772), AAV3 (SEQ ID NO. 8 and 71 of US20030138772), AAV4 (SEQ ID NO. 63 of US20030138772), AAV5 (SEQ ID NO. 114 of US20030138772), AAV6 (SEQ ID NO. 65 of US20030138772), AAV7 (SEQ ID NO. 1-3 of US20030138772), AAV8 (SEQ ID NO. 4 and 95 of US20030138772), AAV9 (SEQ ID NO. 5 and 100 of US20030138772), AAV10 (SEQ ID NO. 117 of US20030138772), AAV11 (SEQ ID NO. 118 of US20030138772), AAV12 (SEQ ID NO. 119 of US20030138772), AAVrh10 (amino acids 1 to 738 of SEQ ID NO. 81 of US20030138772) or variants thereof. Non-limiting examples of variants include SEQ ID NOs. 9, 27-45, 47-62, 66-69, 73-81, 84-94, 96, 97, 99, 101-113 of US20030138772, the contents of which are herein incorporated by reference in their entirety.

In one embodiment, the AAV serotype may have a sequence as described in Pulicherla et al. (*Molecular Therapy,* 2011, 19(6):1070-1078), U.S. Pat. Nos. 6,156,303; 7,198,951; U.S. Patent Publication NOs. US2015/0159173 and US2014/0359799; and International Patent Publication NOs. WO1998/011244, WO2005/033321 and WO2014/14422; the contents of each of which are incorporated herein by reference in their entirety.

AAV vectors include not only single stranded vectors but self-complementary AAV vectors (scAAVs). scAAV vectors contain DNA which anneals together to form double stranded vector genome. By skipping second strand synthesis, scAAVs allow for rapid expression in the cell.

The rAAV vectors may be manufactured by standard methods in the art such as by triple transfection, in sf9 insect cells or in suspension cell cultures of human cells such as HEK293 cells.

The biocircuits, biocircuit components, effector modules, SREs or payload constructs may be encoded in one or more viral genomes to be packaged in the AAV capsids taught herein.

Such vectors or viral genomes may also include, in addition to at least one or two ITRs (inverted terminal repeats), certain regulatory elements necessary for expression from the vector or viral genome. Such regulatory elements are well known in the art and include for example promoters, introns, spacers, stuffer sequences, and the like.

In some embodiments, more than one effector module or SRE (e.g. DD) may be encoded in a viral genome.

4. Oncolytic Viruses

In some embodiments, polynucleotides of present invention may be packaged into oncolytic viruses, such as vaccine viruses. Oncolytic vaccine viruses may include viral particles of a thymidine kinase (TK)-deficient, granulocyte macrophage (GM)-colony stimulating factor (CSF)-expressing, replication-competent vaccinia virus vector sufficient to induce oncolysis of cells in the tumor (e.g., U.S. Pat. No. 9,226,977).

In some embodiments, the viral vector of the invention may comprise two or more immunotherapeutic agents taught herein, wherein the two or more immunotherapeutic agents may be included in one effector module under the regulation of the same DD. In this case, the two or more immunotherapeutic agents are tuned by the same stimulus simultaneously. In other embodiments, the viral vector of the invention may comprise two or more effector modules, wherein each effector module comprises a different immunotherapeutic agent. In this case, the two or more effector modules and immunotherapeutic agents are tuned by different stimuli, providing separately independent regulation of the two or more components.

5. Messenger RNA (mRNA)

In some embodiments, the effector modules of the invention may be designed as a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Such mRNA molecules may have the structural components or features of any of those taught in International Publication No. WO2018151666, the contents of which are incorporated herein by reference in its entirety.

Polynucleotides of the invention may also be designed as taught in, for example, Ribostem Limited in United Kingdom patent application serial number 0316089.2 filed on Jul. 9, 2003 now abandoned, PCT application number PCT/GB2004/002981 filed on Jul. 9, 2004 published as WO2005005622, U.S. patent application national phase entry Ser. No. 10/563,897 filed on Jun. 8, 2006 published as US20060247195 now abandoned, and European patent application national phase entry serial number EP2004743322 filed on Jul. 9, 2004 published as EP1646714 now withdrawn; Novozymes, Inc. in PCT application number PCT/US2007/88060 filed on Dec. 19, 2007 published as WO2008140615, U.S. patent application national phase entry Ser. No. 12/520,072 filed on Jul. 2, 2009 published as US20100028943 and European patent application national phase entry serial number EP2007874376 filed on Jul. 7, 2009 published as EP2104739; University of Rochester in PCT application number PCT/US2006/46120 filed on Dec. 4, 2006 published as WO2007064952 and U.S. patent application Ser. No. 11/606,995 filed on Dec. 1, 2006 published as US20070141030; BioNTech AG in European patent application serial number EP2007024312 filed Dec. 14, 2007 now abandoned, PCT application number PCT/EP2008/01059 filed on Dec. 12, 2008 published as WO2009077134, European patent application national phase entry serial number EP2008861423 filed on Jun. 2, 2010 published as EP2240572, U.S. patent application national phase entry Ser. No. 12/735,060 filed Nov. 24, 2010 published as US20110065103, German patent application serial number DE 10 2005 046 490 filed Sep. 28, 2005, PCT application PCT/EP2006/0448 filed Sep. 28, 2006 published as WO2007036366, national phase European patent EP1934345 published Mar. 21, 2012 and national phase U.S. patent application Ser. No. 11/992,638 filed Aug. 14, 2009 published as 20100129877; Immune Disease Institute Inc. in U.S. patent application Ser. No. 13/088,009 filed Apr. 15, 2011 published as US20120046346 and PCT application PCT/US2011/32679 filed Apr. 15, 2011 published as WO20110130624; Shire Human Genetic Therapeutics in U.S. patent application Ser. No. 12/957,340 filed on Nov. 20, 2010 published as US20110244026; Sequitur Inc. in PCT application PCT/US1998/019492 filed on Sep. 18, 1998 published as WO1999014346; The Scripps Research Institute in PCT application number PCT/US2010/00567 filed on Feb. 24, 2010 published as WO2010098861, and U.S. patent application national phase entry Ser. No. 13/203,229 filed Nov. 3, 2011 published as US20120053333; Ludwig-Maximillians University in PCT application number PCT/EP2010/004681 filed on Jul. 30, 2010 published as WO2011012316; Cellscript Inc. in U.S. Pat. No. 8,039,214 filed Jun. 30, 2008 and granted Oct. 18, 2011, U.S. patent application Ser. No. 12/962,498 filed on Dec. 7, 2010 published as US20110143436, Ser. No. 12/962,468 filed on Dec. 7, 2010 published as US20110143397, Ser. No. 13/237,451 filed on Sep. 20, 2011 published as US20120009649, and PCT applications PCT/US2010/59305 filed Dec. 7, 2010 published as WO2011071931 and PCT/US2010/59317 filed on Dec. 7, 2010 published as WO2011071936; The Trustees of the University of Pennsylvania in PCT application number PCT/US2006/32372 filed on Aug. 21, 2006 published as WO2007024708, and U.S. patent application national phase entry Ser. No. 11/990,646 filed on Mar. 27, 2009 published as US20090286852; Curevac GMBH in German patent application serial numbers DE10 2001 027 283.9 filed Jun. 5, 2001, DE10 2001 062 480.8 filed Dec. 19, 2001, and DE 20 2006 051 516 filed Oct. 31, 2006 all abandoned, European patent numbers EP1392341 granted Mar. 30, 2005 and EP1458410 granted Jan. 2, 2008, PCT application numbers PCT/EP2002/06180 filed Jun. 5, 2002 published as WO2002098443, PCT/EP2002/14577 filed on Dec. 19, 2002 published as WO2003051401, PCT/EP2007/09469 filed on Dec. 31, 2007 published as WO2008052770, PCT/EP2008/03033 filed on Apr. 16, 2008 published as WO2009127230, PCT/EP2006/004784 filed on May 19, 2005 published as WO2006122828, PCT/EP2008/00081 filed on Jan. 9, 2007 published as WO2008083949, and U.S. patent application Ser. No. 10/729,830 filed on Dec. 5, 2003 published as US20050032730, Ser. No. 10/870,110 filed on Jun. 18, 2004 published as US20050059624, Ser. No. 11/914,945 filed on Jul. 7, 2008 published as US20080267873, Ser. No. 12/446,912 filed on Oct. 27, 2009 published as US2010047261 now abandoned, Ser. No. 12/522,214 filed on Jan. 4, 2010 published as US20100189729, Ser. No. 12/787,566 filed on May 26, 2010 published as US20110077287, Ser. No. 12/787,755 filed on May 26, 2010 published as US20100239608, Ser. No. 13/185,119 filed on Jul. 18, 2011 published as US20110269950, and Ser. No. 13/106,548 filed on May 12, 2011 published as US20110311472 all of which are herein incorporated by reference in their entirety.

In some embodiments, the effector modules may be designed as self-amplifying RNA. "Self-amplifying RNA" as used herein refers to RNA molecules that can replicate in the host resulting in the increase in the amount of the RNA and the protein encoded by the RNA. Such self-amplifying RNA may have structural features or components of any of those taught in International Patent Application Publication No. WO2011005799 (the contents of which are incorporated herein by reference in their entirety).

VI. Definitions

At various places in the present specification, features or functions of the compositions of the present disclosure are disclosed in groups or in ranges. It is specifically intended that the present disclosure include each and every individual subcombination of the members of such groups and ranges. The following is a non-limiting list of term definitions.

Activity: As used herein, the term "activity" refers to the condition in which things are happening or being done. Compositions of the invention may have activity and this activity may involve one or more biological events. In some embodiments, biological events may include cell signaling events. In some embodiments, biological events may include cell signaling events associated protein interactions with one or more corresponding proteins, receptors, small molecules or any of the biocircuit components described herein.

Adoptive cell therapy (ACT): The terms "Adoptive cell therapy" or "Adoptive cell transfer", as used herein, refer to a cell therapy involving in the transfer of cells into a patient, wherein cells may have originated from the patient, or from another individual, and are engineered (altered) before being transferred back into the patient. The therapeutic cells may be derived from the immune system, such as Immune effector cells: CD4+ T cell; CD8+ T cell, Natural Killer cell (NK cell); and B cells and tumor infiltrating lymphocytes (TILs) derived from the resected tumors. Most commonly transferred cells are autologous anti-tumor T cells after ex vivo expansion or manipulation. For example, autologous peripheral blood lymphocytes can be genetically engineered to recognize specific tumor antigens by expressing T-cell receptors (TCR) or chimeric antigen receptor (CAR).

Agent: As used herein, the term "agent" refers to a biological, pharmaceutical, or chemical compound. Non-limiting examples include simple or complex organic or inorganic molecule, a peptide, a protein, an oligonucleotide, an antibody, an antibody derivative, antibody fragment, a receptor, and soluble factor.

Agonist: the term "agonist" as used herein, refers to a compound that, in combination with a receptor, can produce a cellular response. An agonist may be a ligand that directly binds to the receptor. Alternatively, an agonist may combine with a receptor indirectly by, for example, (a) forming a complex with another molecule that directly binds to the receptor, or (b) otherwise resulting in the modification of another compound so that the other compound directly binds to the receptor. An agonist may be referred to as an agonist of a particular receptor or family of receptors, e.g., agonist of a co-stimulatory receptor.

Antagonist: the term "antagonist" as used herein refers to any agent that inhibits or reduces the biological activity of the target(s) it binds.

Antigen: the term "antigen" as used herein is defined as a molecule that provokes an immune response when it is introduced into a subject or produced by a subject such as tumor antigens which arise by the cancer development itself. This immune response may involve either antibody production, or the activation of specific immunologically-competent cells such as cytotoxic T lymphocytes and T helper cells, or both. An antigen can be derived from organisms, subunits of proteins/antigens, killed or inactivated whole cells or lysates. In the context of the invention, the terms "antigens of interest" or "desired antigens" refers to those proteins and/or other biomolecules provided herein that are immunospecifically bound or interact with antibodies of the present invention and/or fragments, mutants, variants, and/or alterations thereof described herein. In some embodiments, antigens of interest may comprise any of the polypeptides or payloads or proteins described herein, or fragments or portions thereof.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Alkyl: The terms "alkyl", "alkoxy", "hydroxyalkyl", "alkoxy alkyl", and "alkoxy carbonyl", as used herein, include both straight and branched chains containing one to twelve carbon atoms, and/or which may or may not be substituted.

Alkenyl: The terms "alkenyl" and "alkynyl" as used herein alone or as part of a larger moiety shall include both straight and branched chains containing two to twelve carbon atoms.

Aryl: The term "aryl" as used herein alone or as part of a larger moiety as in "aralkyl", "aralkoxy", or "aryloxyalkyl", refers to monocyclic, bicyclic and tricyclic carbocyclic ring systems having a total of five to fourteen ring members, wherein at least one ring is aromatic and wherein each ring in the system contains 3 to 8 ring members. The term "aryl" may be used interchangeably with the term "aryl ring."

Aromatic: The term "aromatic" as used herein, refers to an unsaturated hydrocarbon ring structure with delocalized pi electrons. As used herein "aromatic" may refer to a monocyclic, bicyclic or polycyclic aromatic compounds.

Aliphatic: The term "aliphatic" or "aliphatic group" as used herein, refers to a straight or branched C1-C8 hydrocarbon chain or a monocyclic C3-C8 hydrocarbon or bicyclic C8-C12 hydrocarbon which are fully saturated or that contains one or more units of unsaturation, that is completely saturated or that contains one or more units of unsaturation, but which is not aromatic (also referred to herein as "carbocycle" or "cycloalkyl"), and that has a single point of attachment to the rest of the molecule wherein any individual ring in said bicyclic ring system has 3-7 members.

Associated with: As used herein, the terms "associated with," "conjugated," "linked," "attached," and "tethered," when used with respect to two or more moieties, mean that the moieties are physically associated or connected with one another, either directly or via one or more additional moieties that serve as linking agents, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Autologous: the term "autologous" as used herein is meant to refer to any material derived from the same individual to which it is later to be re-introduced into the individual.

Barcode: the term "barcode" as used herein refers to polynucleotide or amino acid sequence that distinguishes one polynucleotide or amino acid from another.

Biocircuit system: As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present invention and effect signals or outcomes in acellular environments such as with diagnostic, reporter systems, devices, assays or kits. The artificial circuits may be associated with one or more electronic, magnetic, or radioactive components or parts. In the context of the present invention, a biocircuit includes a destabilizing domain (DD) biocircuit system.

Cancer: the term "cancer" as used herein refers a broad group of various diseases characterized by the uncontrolled growth of abnormal cells in the body. Unregulated cell division and growth results in the formation of malignant tumors that invade neighboring tissues ultimately metastasize to distant parts of the body through the lymphatic system or bloodstream.

Conservative amino acid substitution: As used herein a "conservative amino acid substitution is one in which an amino acid residue is substituted by another amino acid residue having a side chain (R group) with similar properties (e.g charge or hydrophobicity).

Co-stimulatory molecule: As used herein, in accordance with its meaning in immune T cell activation, refers to a group of immune cell surface receptor/ligands which engage between T cells and APCs and generate a stimulatory signal in T cells which combines with the stimulatory signal in T cells that results from T cell receptor (TCR) recognition of antigen/MHC complex (pMHC) on APCs Cytokines: the term "cytokines", as used herein, refers to a family of small soluble factors with pleiotropic functions that are produced by many cell types that can influence and regulate the function of the immune system.

Delivery: the term "delivery" as used herein refers to the act or manner of delivering a compound, substance, entity, moiety, cargo or payload. A "delivery agent" refers to any agent which facilitates, at least in part, the in vivo delivery of one or more substances (including, but not limited to a compound and/or compositions of the present invention) to a cell, subject or other biological system cells.

Destabilized: As used herein, the term "destable," "destabilize," destabilizing region" or "destabilizing domain" means a region or molecule that is less stable than a starting, reference, wild-type or native form of the same region or molecule.

Engineered: As embodiments of the invention are "engineered" when they are designed to have a feature or property, whether structural or chemical, that varies from a starting point, wild type or native molecule.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

Feature: As used herein, a "feature" refers to a characteristic, a property, or a distinctive element.

Formulation: As used herein, a "formulation" includes at least a compound and/or composition of the present invention and a delivery agent.

Fragment: A "fragment," as used herein, refers to a portion. For example, fragments of proteins may comprise polypeptides obtained by digesting full-length protein. In some embodiments, a fragment of a protein includes at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250 or more amino acids. In some embodiments, fragments of an antibody include portions of an antibody.

Functional: As used herein, a "functional" biological molecule is a biological entity with a structure and in a form in which it exhibits a property and/or activity by which it is characterized.

Heterocycle: The term "heterocycle", "heterocyclyl", or "heterocyclic" as used herein refers to monocyclic, bicyclic or tricyclic ring systems having three to fourteen ring members in which one or more ring members is a heteroatom, wherein each ring in the system contains 3 to 7 ring members and is non-aromatic.

Hotspot: As used herein, a "hotspot" or a "mutational hotspot" refers to an amino acid position in a protein coding gene that is mutated (by substitutions) more frequently relative to elsewhere within the same gene.

Immune cells: the term "an immune cell", as used herein, refers to any cell of the immune system that originates from a hematopoietic stem cell in the bone marrow, which gives rise to two major lineages, a myeloid progenitor cell (which give rise to myeloid cells such as monocytes, macrophages, dendritic cells, megakaryocytes and granulocytes) and a lymphoid progenitor cell (which give rise to lymphoid cells such as T cells, B cells and natural killer (NK) cells). Exemplary immune system cells include a CD4+ T cell, a CD8+ T cell, a CD4–CD8– double negative T cell, a T γδ cell, a Tαβ cell, a regulatory T cell, a natural killer cell, and a dendritic cell. Macrophages and dendritic cells may be referred to as "antigen presenting cells" or "APCs," which are specialized cells that can activate T cells when a major histocompatibility complex (MHC) receptor on the surface of the APC complexed with a peptide interacts with a TCR on the surface of a T cell.

Immunotherapy: the term "immunotherapy" as used herein, refers to a type of treatment of a disease by the induction or restoration of the reactivity of the immune system towards the disease.

Immunotherapeutic agent: the term "immunotherapeutic agent" as used herein, refers to the treatment of disease by the induction or restoration of the reactivity of the immune system towards the disease with a biological, pharmaceutical, or chemical compound.

$IC_{50}$: As used herein, the term "$IC_{50}$" refers to the concentration of the ligand where the response or binding is reduced to half.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Linker: As used herein, a linker refers to a moiety that connects two or more domains, moieties or entities. In one embodiment, a linker may comprise 10 or more atoms. In a further embodiment, a linker may comprise a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. In some embodiments, a linker may comprise one or more nucleic acids comprising one or more nucleotides. In some embodiments, the linker may comprise an amino acid, peptide, polypeptide or protein. In some embodiments, a moiety bound by a linker may include, but is not limited to an atom, a chemical group, a nucleoside, a nucleotide, a nucleobase, a sugar, a nucleic acid, an amino acid, a peptide, a polypeptide, a protein, a protein complex, a payload (e.g., a therapeutic agent), or a marker (including, but not limited to a chemical, fluorescent, radioactive or bioluminescent marker). The linker can be used for any useful purpose, such as to form multimers or conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bonds include an amido bond which may be cleaved for example by the use of tris(2-carboxyethyl) phosphine (TCEP), or other reducing agents, and/or photolysis, as well as an ester bond which may be cleaved for example by acidic or basic hydrolysis.

Checkpoint/factor: As used herein, a checkpoint factor is any moiety or molecule whose function acts at the junction of a process. For example, a checkpoint protein, ligand or receptor may function to stall or accelerate the cell cycle.

Metabolite: Metabolites are the intermediate products of metabolic reactions catalyzed by enzymes that naturally occur within cells. This term is usually used to describe small molecules, fragments of larger biomolecules or processed products.

MOI: As used herein, the term "MOI" refers to the multiplicity of infection which is defined as the average number of virus particles infecting a target cell.

Modified: As used herein, the term "modified" refers to a changed state or structure of a molecule or entity as compared with a parent or reference molecule or entity. Molecules may be modified in many ways including chemically, structurally, and functionally. In some embodiments, compounds and/or compositions of the present invention are modified by the introduction of non-natural amino acids.

Mutation: As used herein, the term "mutation" refers to a change and/or alteration. In some embodiments, mutations may be changes and/or alterations to proteins (including peptides and polypeptides) and/or nucleic acids (including polynucleic acids). In some embodiments, mutations comprise changes and/or alterations to a protein and/or nucleic acid sequence. Such changes and/or alterations may comprise the addition, substitution and or deletion of one or more amino acids (in the case of proteins and/or peptides) and/or nucleotides (in the case of nucleic acids and or polynucleic acids, e.g., polynucleotides). In some embodiments, wherein mutations comprise the addition and/or substitution of amino acids and/or nucleotides, such additions and/or substitutions may comprise 1 or more amino acid and/or nucleotide residues and may include modified amino acids and/or nucleotides. The resulting construct, molecule or sequence of a mutation, change or alteration may be referred to herein as a mutant.

Neoantigen: the term "neoantigen", as used herein, refers to a tumor antigen that is present in tumor cells but not normal cells and do not induce deletion of their cognate antigen specific T cells in thymus (i.e., central tolerance). These tumor neoantigens may provide a "foreign" signal, similar to pathogens, to induce an effective immune response needed for cancer immunotherapy. A neoantigen may be restricted to a specific tumor. A neoantigen be a peptide/protein with a missense mutation (missense neoantigen), or a new peptide with long, completely novel stretches of amino acids from novel open reading frames (neoORFs). The neoORFs can be generated in some tumors by out-of-frame insertions or deletions (due to defects in DNA mismatch repair causing microsatellite instability), gene-fusion, read-through mutations in stop codons, or translation of improperly spliced RNA (e.g., Saeterdal et al., *Proc Natl Acad Sci USA,* 2001, 98: 13255-13260).

Off-target: As used herein, "off target" refers to any unintended effect on any one or more target, gene, cellular transcript, cell, and/or tissue.

Operably linked: As used herein, the phrase "operably linked" refers to a functional connection between two or more molecules, constructs, transcripts, entities, moieties or the like.

Payload or payload of interest (POI): the terms "payload" and "payload of interest (POI)", as used herein, are used interchangeable. A payload of interest (POI) refers to any protein or compound whose function is to be altered. In the context of the present invention, the POI is a component in the immune system, including both innate and adaptive immune systems. Payloads of interest may be a protein, a fusion construct encoding a fusion protein, or non-coding gene, or variant and fragment thereof. Payload of interest may, when amino acid based, may be referred to as a protein of interest.

Pharmaceutically acceptable excipients: the term "pharmaceutically acceptable excipient," as used herein, refers to any ingredient other than active agents (e.g., as described herein) present in pharmaceutical compositions and having the properties of being substantially nontoxic and non-inflammatory in subjects. In some embodiments, pharmaceutically acceptable excipients are vehicles capable of suspending and/or dissolving active agents. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, cross-linked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: Pharmaceutically acceptable salts of the compounds described herein are forms of the disclosed compounds wherein the acid or base moiety is in its salt form (e.g., as generated by reacting a free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. Pharmaceutically acceptable salts include the conventional non-toxic salts, for example, from non-toxic inorganic or organic acids. In some embodiments, a pharmaceutically acceptable salt is prepared from a parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in Remington's Pharmaceutical Sciences, 17th ed., Mack Publishing Company, Easton, Pa., 1985, p. 1418, Pharmaceutical Salts: Properties, Selection, and Use, P. H. Stahl and C. G. Wermuth (eds.), Wiley-VCH, 2008, and Berge et al., Journal of Pharmaceutical Science, 66, 1-19 (1977), each of which is incorporated herein by reference in its entirety. Pharmaceutically acceptable solvate: The term "pharmaceutically acceptable solvate," as used herein, refers to a crystalline form of a compound wherein molecules of a suitable solvent are incorporated in the crystal lattice. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N, N'-dimethylformamide (DMF), N, N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate." In some embodiments, the solvent incorporated into a solvate is of a type or at a level that is physiologically tolerable to an organism to which the solvate is administered (e.g., in a unit dosage form of a pharmaceutical composition).

Protein of interest: As used herein, the terms "proteins of interest" or "desired proteins" include those provided herein and fragments, mutants, variants, and alterations thereof.

Purine: As used herein, "purine" refers to an aromatic heterocyclic structure, wherein one of the heterocycles is an imidazole ring and one of the heterocycles is a pyrimidine ring.

Pyrimidine: As used herein, "pyrimidine" refers to an aromatic heterocyclic structure similar to benzene, but wherein two of the carbon atoms are replaced by nitrogen atoms.

Pyridopyrimidine: As used herein, "Pyridopyrimidine" refers to an aromatic heterocyclic structure, wherein one of the heterocycles is a purine ring and one of the heterocycles is a pyrimidine ring.

Quinazoline: As used herein, the term, "Quinazoline" refers to an aromatic heterocyclic structure, wherein one of the heterocycles is a benzene ring and one of the heterocycles is a pyrimidine ring.

Standard CAR: As used herein, the term "standard CAR" refers to the standard design of a chimeric antigen receptor. The components of a CAR fusion protein including the extracellular scFv fragment, transmembrane domain and one or more intracellular domains are linearly constructed as a single fusion protein.

Stable: As used herein "stable" refers to a compound or entity that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable. In some embodiments, stability is measured relative to an absolute value. In some embodiments, stability is measured relative to a secondary status or state or to a reference compound or entity.

Stimulus response element (SRE): the term "stimulus response element (SRE), as used herein, is a component of an effector module which is joined, attached, linked to or associated with one or more payloads of the effector module and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1 and 100 or a factored increase or decrease such as 2-fold, 3-fold, 4-fold, 5-fold, 10-fold or more. One non-limiting example of an SRE is a destabilizing domain (DD).

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

T cell: A T cell is an immune cell that produces T cell receptors (TCRs). T cells can be naïve (not exposed to antigen; increased expression of CD62L, CCR7, CD28, CD3, CD127, and CD45RA, and decreased expression of CD45RO as compared to $T_{CM}$), memory T cells ($T_M$) (antigen-experienced and long-lived), and effector cells (antigen-experienced, cytotoxic). TM can be further divided into subsets of central memory T cells ($T_{CM}$, increased expression of CD62L, CCR7, CD28, CD127, CD45RO, and CD95, and decreased expression of CD54RA as compared to naïve T cell and effector memory T cells ($T_{EM}$, decreased expression of CD62L, CCR7, CD28, CD45RA, and increased expression of CD127 as compared to naïve T cells or $T_{CM}$). Effector T cells ($T_E$) refers to antigen-experienced CD8+ cytotoxic T lymphocytes that have decreased expression of CD62L, CCR7, CD28, and are positive for granzyme and perforin as compared to $T_{CM}$. Other exemplary T cells include regulatory T cells, such as CD4+CD25+(Foxp3+) regulatory T cells and Treg17 cells, as well as Tr1, Th3, CD8+CD28−, and Qa-1 restricted T cells.

T cell receptor: T cell receptor (TCR) refers to an immunoglobulin superfamily member having a variable antigen binding domain, a constant domain, a transmembrane region, and a short cytoplasmic tail, which is capable of specifically binding to an antigen peptide bound to a MHC receptor. A TCR can be found on the surface of a cell or in soluble form and generally is comprised of a heterodimer having α and β chains (also known as TCRα and TCRβ, respectively), or γ and δ chains (also known as TCRγ and TCRδ, respectively). The extracellular portion of TCR chains (e.g., α-chain, β-chain) contains two immunoglobulin domains, a variable domain (e.g., α-chain variable domain or $V_α$, β-chain variable domain or $V_β$) at the N-terminus, and one constant domain (e.g., α-chain constant domain or $C_α$ and Pβ-chain constant domain or $C_β$) adjacent to the cell membrane. Similar to immunoglobulin, the variable domains contain complementary determining regions (CDRs) separated by framework regions (FRs). A TCR is usually associated with the CD3 complex to form a TCR complex. As used herein, the term "TCR complex" refers to a complex formed by the association of CD3 with TCR. For example, a TCR complex can be composed of a CD3γ chain, a CD3δ chain, two CD3ε chains, a homodimer of CD3ζ chains, a TCRα chain, and a TCRβ chain. Alternatively, a TCR complex can be composed of a CD3γ chain, a CD3δ chain, two CD3ε chains, a homodimer of CD3ζ chains, a TCRγ chain, and a TCRδ chain. A "component of a TCR complex," as used herein, refers to a TCR chain (i.e., TCRα, TCRβ, TCRγ or TCRδ), a CD3 chain (i.e., CD3γ, CD3δ, CD3ε or CD3ζ), or a complex formed by two or more TCR chains or CD3 chains (e.g., a complex of TCRα and TCRβ, a complex of TCRγ and TCRδ, a complex of CD3ε and CD3δ, a complex of CD3γ and CD3ε, or a sub-TCR complex of TCRα, TCRβ, CD3γ, CD3δ, and two CD3ε chains.

Therapeutic Agent: The term "therapeutic agent" refers to any agent that, when administered to a subject, has a therapeutic, diagnostic, and/or prophylactic effect and/or elicits a desired biological and/or pharmacological effect. Therapeutic agents of the present invention include any of the biocircuit components taught herein either alone or in combination with other therapeutic agents.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Triazine: As used herein, "triazine" is a class of nitrogen containing heterocycles with a structure similar to benzene, but wherein three carbon atoms are replaced by nitrogen atoms.

Treatment or treating: As used herein, the terms "treatment" or "treating" denote an approach for obtaining a beneficial or desired result including and preferably a beneficial or desired clinical result. Such beneficial or desired clinical results include, but are not limited to, one or more of the following: reducing the proliferation of (or destroying) cancerous cells or other diseased, reducing metastasis of cancerous cells found in cancers, shrinking the size of the tumor, decreasing symptoms resulting from the disease, increasing the quality of life of those suffering from the disease, decreasing the dose of other medications required to treat the disease, delaying the progression of the disease, and/or prolonging survival of individuals.

Tune: As used herein, the term "tune" means to adjust, balance or adapt one thing in response to a stimulus or toward a particular outcome. In one non-limiting example, the SREs and/or DDs of the present invention adjust, balance or adapt the function or structure of compositions to which they are appended, attached or associated with in response to particular stimuli and/or environments.

Variant: As used herein, the term "variant" refers to a first composition (e.g., a first DD or payload), that is related to a second composition (e.g., a second DD or payload, also termed a "parent" molecule). The variant molecule can be derived from, isolated from, based on or homologous to the parent molecule. The term variant can be used to describe either polynucleotides or polypeptides.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the invention in its broader aspects.

EXAMPLES

Example 1. Generation of Novel Ligand Responsive SREs or DDs by Mutagenesis Screening Study Design To engineer constructs that display ligand dependent stability, a candidate ligand binding domain (LBD) is selected and a cell-based screen using yellow fluorescent protein (YFP) as a reporter for protein stability is designed to identify mutants of the candidate LBD possessing the desired characteristics of a destabilizing domain: low protein levels in the absence of a ligand of the LBD, (i.e., low basal stability), large dynamic range, robust and predictable dose-response behavior, and rapid kinetics of degradation (Banaszynski, et al., (2006) Cell; 126(5): 995-1004). The candidate LBD binds to a desired ligand but not endogenous signaling molecules.

The candidate LBD sequence (as a template) is first mutated using a combination of nucleotide analog mutagenesis and error-prone PCR, to generate libraries of mutants based on the template candidate domain sequence. The libraries generated are cloned in-frame at either the 5'- or 3'-ends of the YFP gene, and a retroviral expression system is used to stably transduce the libraries of YFP fusions into NIH3T3 fibroblasts.

The transduced NIH3T3 cells are subjected to three to four rounds of sorting using fluorescence-activated cell sorting (FACS) to screen the libraries of candidate DDs. Transduced NIH3T3 cells are cultured in the absence of the high affinity ligand of the ligand binding domain (LBD), and cells that exhibit low levels of YFP expression are selected through FACS.

Screening Strategy I

The selected cell population is cultured in the presence of the high affinity ligand of the ligand binding domain for a period of time (e.g., 24 hours), at which point cells are sorted again by FACS. Cells that exhibit high levels of YFP expression are selected through FACS and the selected cell population is split into two groups and treated again with the high affinity ligand of the ligand binding domain at different concentrations; one group is treated with the lower concentration of the ligand and the other is treated with a high concentration of the ligand, for a period of time (e.g., 24 hours), at which point cells are sorted again by FACS. Cells expressing mutants that are responsive to lower concentrations of the ligand are isolated.

The isolated cells responsive to the lower concentration of the ligand are treated with the ligand again and cells exhibiting low fluorescence levels are collected 4 hours following removal of the ligand from the media. This fourth sorting is designed to enrich cells that exhibit fast kinetics of degradation (Iwamoto et al., Chem Biol. 2010 Sep. 24; 17(9): 981-988).

Screening Strategy II

The selected cell population is subject to additional one or more sorts by FACS in the absence of high affinity ligand of LBD and cells that exhibit low levels of YFP expression are selected for further analysis. Cells are treated with high affinity ligand of the ligand binding domain, for a period of time (e.g. 24 hours), and sorted again by FACS. Cells expressing high levels of YFP are selected for through FACS. Cells with high expression of YFP are treated with ligand again and cells exhibiting low fluorescence levels are collected 4 hours following removal of the ligand from the media to enrich cells that exhibit fast kinetics of degradation. Any of the sorting steps may be repeated to identify DDs with ligand dependent stability.

The cells are recovered after sorting. The identified candidate cells are harvested and the genomic DNA is extracted. The candidate DDs are amplified by PCR and isolated. The candidate DDs are sequenced and compared to the LBD template to identify the mutations in candidate DDs.

Example 2. Novel DDs Derived from Human DHFR by Site Directed Mutagenesis

Known destabilizing mutations in E. coli DHFR (ecDHFR) were mapped onto the structure of human DHFR (hDHFR) and corresponding mutations in wild type hDHFR protein were generated using site directed mutagenesis. hDHFR mutants were then fused to a linker, GGSGGG (SEQ ID NO: 2728) and a GFP reporter gene at the N terminus. The stability of the mutants in response to TMP and MTX was tested. The hDHFR N terminus mutant construct cloned into pLVX. IRES. The reporter constructs were transfected into NIH 3T3 cells. Transfected cells were incubated with either 1 µM MTX or 10 µM TMP for 48 hours. DMSO was used as control. Fluorescence signal was measured by FACS and median fluorescence signal intensity was calculated. Median fluorescence intensity following DMSO treatment are shown in Table 44. The destabilizing mutation co-efficient was calculated as the fold change in GFP intensity in the hDHFR mutant constructs compared to the hDHFR (WT) in the absence of the ligand. Destabilizing mutation co-efficients less than 1 are desired in DDs.

TABLE 44 hDHFR mutants without ligand

| Construct | Median Fluorescence signal with DMSO | Destabilizing mutation co-efficient |
|---|---|---|
| NIH-3T3 cells (Control) | 1.78 | — |
| OT-hDHFRN-001 (hDHFR WT) | 18 | — |
| OT-hDHFRN-002 (hDHFR Y122I) | 4.67 | 0.26 |
| OT-hDHFRN-003 (hDHFR M53T, R138I) | 2.29 | 0.13 |
| OT-hDHFRN-004 (hDHFR V75F, Y122I) | 2.43 | 0.14 |
| OT-hDHFRN-005 (hDHFR A125F, Y122I) | 2.55 | 0.14 |
| OT-hDHFRN-021 (hDHFR V121A, Y122I) | 2.83 | 0.16 |
| OT-hDHFRN-006 (hDHFR L74N, Y122I) | 2.94 | 0.16 |
| OT-hDHFRN-007 (hDHFR L94A, T147A) | 2.67 | 0.15 |
| OT-hDHFRN-008 (hDHFR G21T, Y122I) | 3.27 | 0.18 |

The median florescence intensity of all human DHFR mutants was comparable to the parental untransfected cells. OT-hDHFRN-003 (hDHFR M53T, R138I) and OT-hDHFRN-004 (hDHFR V75F, Y122I) showed the lowest median fluorescence intensity among the mutants tested. As expected, the median fluorescence intensity observed with the hDHFR wildtype (OT-hDHFRN-001) was much higher than the hDHFR mutants as well as the control cells. A destabilizing mutation co-efficient less than one was observed with all hDHFR mutant constructs. These results show that the hDHFR mutants tested show low basal stability in the absence of ligand.

To test if the low fluorescence intensity observed with the hDHFR mutants is indeed due to destabilization, the fluorescence intensity following MTX or TMP treatment was measured and compared with the control DMSO. Table 45 shows fold change in median GFP intensity in ligand treated hDHFR mutants when compared to DMSO.

TABLE 45

GFP intensity with ligand treatment

| | Fold Change | |
|---|---|---|
| Construct | 1 µM MTX | 10 µM TMP |
| NIH-3T3 cells (Control) | 1.31 | 0.88 |
| OT-hDHFRN-001 (hDHFR WT) | 6.78 | 4.68 |
| OT-hDHFRN-002 (hDHFR Y122I) | 14.41 | 11.46 |
| OT-hDHFRN-003 (hDHFR M53T, R138I) | 3.36 | 1.02 |
| OT-hDHFRN-004 (hDHFR V75F, Y122I) | 4.00 | 1.02 |
| OT-hDHFRN-005 (hDHFR A125F, Y122I) | 26.98 | 6.24 |
| OT-hDHFRN-021 (hDHFR V121A, Y122I) | 15.58 | 1.58 |
| OT-hDHFRN-006 (hDHFR L74N, Y122I) | 8.30 | 1.03 |
| OT-hDHFRN-007 (hDHFR L94A, T147A) | 4.46 | 1.00 |
| OT-hDHFRN-008 (hDHFR G21T, Y122I) | 14.53 | 1.30 |

As shown in the Table 45, hDHFR Y122I (OT-hDHFRN-002), hDHFR A125F, and Y122I (OT-hDHFRN-005) showed a fold change increase in GFP intensity with MTX and TMP, suggesting a MTX and TMP dependent stabilization of the DD. The rest of the mutants showed an increase in GFP only with MTX suggesting hDHFR stabilization only with MTX treatment.

Percentage of GFP positive cells as a measure of ligand dependent DD stabilization in each transfection was calculated using FACS Calibur™ (see Table 46).

TABLE 46 hDHFR mutants with ligand

| | % GFP positive cells | | |
|---|---|---|---|
| Construct | DMSO | 1 µM MTX | 10 µM TMP |
| NIH-3T3 cells (Control) | 0.03 | 0.18 | 0.04 |
| OT-hDHFRN-001 (hDHFR WT) | 61.5 | 96 | 97.2 |
| OT-hDHFRN-002 (hDHFR Y122I) | 5.34 | 92.5 | 91.2 |
| OT-hDHFRN-003 (hDHFR M53T, R138I) | 0.55 | 22.3 | 0.97 |
| OT-hDHFRN-004 (hDHFR V75F, Y122I) | 0.5 | 33.7 | 0.39 |
| OT-hDHFRN-005 (hDHFR A125F, Y122I) | 0.64 | 89.6 | 54.7 |
| OT-hDHFRN-021 (hDHFR V121A, Y122I) | 0.85 | 83.8 | 5.54 |
| OT-hDHFRN-006 (hDHFR L74N, Y122I) | 0.93 | 72 | 0.72 |
| OT-hDHFRN-007 (hDHFR L94A, T147A) | 0.26 | 40.7 | 0.52 |
| OT-hDHFRN-008 (hDHFR G21T, Y122I) | 0.61 | 86.6 | 2.92 |

As shown in the Table 46, the percentage of GFP positive cells in the hDHFR mutants was low with DMSO treatment and comparable to the control cells. The wildtype hDHFR (OT-hDHFRN-001) showed a high percentage of GFP positive cells with DMSO treatment. To test if the low percentage of GFP positive cells in the hDHFR mutants was due to destabilization in the absence of ligand, cells were treated with stabilizing ligands i.e. 1 µM MTX or 10 µM TMP. OT-hDHFRN-002 (hDHFR Y122I), OT-hDHFRN-005 (hDHFR A125F, Y122I) and OT-hDHFRN-021 (hDHFR V121A, Y122I) showed an increase in the percentage of GFP positive cells indicating a ligand dependent stabilization. OT-DHFRN-003, OT-DHFRN-004, OT-DHFRN-006 OT-DHFRN-007 and OT-DHFRN-008 showed MTX specific stabilization as indicated by the increase in the percentage of GFP positive cells following MTX treatment.

The stability of hDHFR mutants was also evaluated at the protein level. hDHFR WT and mutants (hDHFR(Y122I), hDHFR (M53T, R138I), hDHFR (V75F, Y122I), hDHFR (A125F, Y122I), hDHFR (V121A, Y122I), hDHFR (L74N, Y122I), hDHFR (L94A, T147A), hDHFR (G21T, Y122I) were immunoblotted after TMP or MTX or DMSO treatment for 48 hours. Anti-AcGFP antibody (Clonetech, Mountain View, Calif.) and anti-hDHFR antibody (GeneTex Cat. NO. GTX117705) were used for western blotting. As shown in FIG. 19A-FIG. 19F, the protein levels of hDHFR mutants, hDHFR(Y122I), hDHFR (A125F, Y122I) and hDHFR (V121A, Y122I) were stabilized following treatment with both MTX and TMP. hDHFR mutants including OT-DHFRN-006 OT-DHFRN-007 and OT-DHFRN-008 showed stabilization exclusively with MTX. Wild type hDHFR showed enhanced stabilization upon addition of MTX and TMP. The results were consistent using both the AcGFP antibody as well as the hDHFR antibody.

Example 3. Novel DDs Derived from Human DHFR by Random Mutagenesis

To identify novel destabilizing domain mutations, mutagenic PCR was performed on human DHFR open reading frame using forward primer (MutCP-For: GAAT-TCCTCGAGGCCACCATG (with XhoI site)(SEQ ID NO. 6411)) and reverse primer (MutCP-Rev: CCACCAGAGC-CACCACTAGT (with SpeI site)(SEQ ID NO. 6412)) using non-natural nucleotides. The mutant library was ligated in frame with an AcGFP reporter at the C-terminus into pLVX-IRES-Puro vector and packaged into lentivirus. The lentivirus library was then used to infect HEK293T cells at multiplicity of infection (MOI) of 0.3. Stably transduced cells were selected with puromycin. Cells were then treated with 1 μM Methotrexate or 10 μM Trimethoprim for 48 hrs. Following ligand treatment, cells showing >95% median fluorescence intensity GFP were sorted by FACS. The sorted population was treated with 1 μM Methotrexate or 10 μM Trimethoprim for 48 hours and cells showing >95% median fluorescence intensity were sorted again. The cells were passaged for a few generations following the sort and cells showing <5% median fluorescence intensity in the absence of ligand were sorted again. Cells were treated with 1 μM Methotrexate or 10 μM Trimethoprim for 48 hours and cells showing >95% median fluorescence intensity were selected. DNA was extracted from the cell pool, the DHFR locus was PCR amplified and sequenced. Clone C1-12 3 provides the sequence identity of the clones generated by error prone PCR based mutagenesis. The sequence confirmed clones were ligated in frame to AcGFP reporter at the C-terminus into pLVX-IRES-Puro and transformed into E. coli. Individual clones were sequenced and packaged into lentivirus. HEK293 cells were transduced with the lentivirus and stable integrants were selected with puromycin. Cells expressing individual clones were then incubated with vehicle, Dimethylsulfoxide (DMSO), 10 or 50 μM Trimethoprim or 1 μM Methotrexate. Median GFP fluorescence was quantified using FACS and the results from various experiments are presented in Tables 47-50. The stabilization ratio was calculated as the fold change in GFP intensity in ligand treated samples compared to treatment with DMSO (i.e. in the absence of ligand) with the same construct. The destabilizing mutation co-efficient was calculated as the fold change in GFP intensity in the DHFR mutant constructs in the absence of the ligand compared to the wildtype DHFR construct. Destabilizing mutation co-efficient less than 1 and stabilization ratios greater than 1 are desired in DDs.

TABLE 47

Ligand dependent hDHFR mutant expression

| hDHFR mutant | Median fluorescence intensity | | | De-stabilizing mutation co-efficient | Stabilization Ratio | |
|---|---|---|---|---|---|---|
| | DMSO | 10 μM TMP | 1 μM MTX | | 10 μM TMP | 1 μM MTX |
| hDHFR (WT) | 83.6 | 398 | 459 | — | 4.76 | 5.49 |
| Clone C1-12 (hDHFR (K81R)) | 254 | 1411 | 1625 | 3.04 | 5.56 | 6.40 |
| Clone C1-18 (hDHFR (V9A, S93R, P150L)) | 6.37 | 6.6 | 353 | 0.08 | 1.04 | 55.42 |
| Clone C1-4 (hDHFR (F59S)) | 6.08 | 107 | 1380 | 0.07 | 17.60 | 226.97 |
| Clone C1-8 (hDHFR (I17V)) | 19.6 | 605 | 1624 | 0.23 | 30.87 | 82.86 |
| Clone C1-11 (hDHFR (N65D)) | 334 | 1100 | 1000 | 4.00 | 3.29 | 2.99 |
| Clone C2-21 (hDHFR (A10V, H88Y)) | 1.66 | 1.64 | 211 | 0.02 | 0.99 | 127.11 |

TABLE 48

Ligand dependent hDHFR mutant expression

| hDHFR mutant | Median fluorescence intensity | | | De-stabilizing mutation co-efficient | Stabilization Ratio | |
|---|---|---|---|---|---|---|
| | DMSO | 50 μM TMP | 1 μM MTX | | 10 μM TMP | 1 μM MTX |
| hDHFR WT | 399 | 2507 | 2033 | — | 6.28 | 5.10 |
| Clone C1-3 (hDHFR (A107V)) | 79.7 | 947 | 859 | 0.20 | 11.88 | 10.78 |
| Clone C1-10 (hDHFR (C7R, Y163C)) | 6.84 | 7.36 | 13 | 0.02 | 1.08 | 1.90 |
| Clone C1-14 (hDHFR (N127Y)) | 12.8 | 1023 | 1197 | 0.03 | 79.92 | 93.52 |
| Clone C1-21 (hDHFR (K185E)) | 3.96 | 427 | 1267 | 0.01 | 107.83 | 319.95 |
| Clone C1-25 (hDHFR (T137R, F143L)) | 4.03 | 4.42 | 4.9 | 0.01 | 1.10 | 1.22 |
| Clone C2-8 (hDHFR (I8V, K133E, Y163C)) | 3.81 | 3.41 | 116 | 0.01 | 0.90 | 30.45 |
| Clone C2-15 (hDHFR (K19E, F89L, E181G)) | 3.61 | 4.21 | 504 | 0.01 | 1.17 | 139.61 |
| Clone C2-20 (hDHFR (N186D)) | 109 | 948 | 897 | 0.27 | 8.70 | 8.23 |
| Clone C2-22 (hDHFR (G54R, M140V, S168C)) | 2.69 | 2.81 | 3.44 | 0.01 | 1.04 | 1.28 |
| Clone C2-23 (hDHFR (L23S, V121A, Y157C)) | 3.33 | 4.5 | 307 | 0.01 | 1.35 | 92.19 |

TABLE 49

Ligand dependent hDHFR mutant expression

| hDHFR mutant | Median fluorescence intensity | | | De-stabilizing mutation co-efficient | Stabilization Ratio | |
|---|---|---|---|---|---|---|
| | DMSO | 50 μM TMP | 1 μM MTX | | 10 μM TMP | 1 μM MTX |
| hDHFR WT | 253 | 1560 | 1296 | — | 6.17 | 5.12 |
| Clone C1-24 (hDHFR (V110A, V136M, K177R)) | 3.62 | 51.2 | 1010 | 0.01 | 14.14 | 279.01 |
| Clone C2-25 (hDHFR (E162G, I176F)) | 5.24 | 564 | 1487 | 0.02 | 107.63 | 283.78 |
| Clone C3-1 (hDHFR (Y178H, E181G)) | 3.52 | 4.1 | 315 | 0.01 | 1.16 | 89.49 |
| Clone C3-2 (hDHFR (N49D, F59S, D153G)) | 5.26 | 6.49 | 31.2 | 0.02 | 1.23 | 5.93 |

TABLE 49-continued

Ligand dependent hDHFR mutant expression

| hDHFR mutant | Median fluorescence intensity | | | De-stabilizing mutation co-efficient | Stabilization Ratio | |
|---|---|---|---|---|---|---|
| | DMSO | 50 µM TMP | 1 µM MTX | | 10 µM TMP | 1 µM MTX |
| hDHFR (M140I) | 18.4 | 1661 | 1946 | 0.07 | 90.27 | 105.76 |
| Clone C3-9 (hDHFR (H131R, E144G)) | 13.3 | 1332 | 2005 | 0.05 | 100.15 | 150.75 |
| Clone C3-22 (hDHFR (T57A, I72A)) | 5.71 | 7.28 | 714 | 0.02 | 1.27 | 125.04 |

TABLE 50

Ligand dependent hDHFR mutant expression

| hDHFR mutant | Median fluorescence intensity | | | De-stabilizing mutation co-efficient | Stabilization Ratio | |
|---|---|---|---|---|---|---|
| | DMSO | 50 µM TMP | 1 µM MTX | | 10 µM TMP | 1 µM MTX |
| hDHFR WT | 114 | 943 | 844 | — | 8.27 | 7.40 |
| Clone C3-10 (hDHFR (Y183H, K185E)) | 2.03 | 2.11 | 242 | 0.02 | 1.04 | 119.21 |
| Clone C4-3 (hDHFR (G21E, I72V, I176T)) | 2.34 | 2.57 | 443 | 0.02 | 1.10 | 189.32 |

Based on the results presented in Tables 47-50, the hDHFR mutants can be classified into four groups with reference to GFP intensity with DMSO or ligand treatment as compared to the wildtype as well as their stabilization and destabilizing mutation co-efficient s. One group of hDHFR mutants showed low GFP intensity compared to WT with DMSO treatment and high GFP intensity with both MTX and TMP treatment suggesting that the mutants are destabilized in the absence of ligand, but are stabilized in the presence of both ligands. Mutants that showed this behavior include Clone C1-4(hDHFR(F59S)), Clone C1-8 (hDHFR (I17V)), Clone C1-3 (hDHFR (A107V)), Clone C1-14 (hDHFR (N127Y), Clone C1-21(hDHFR (K185E)), Clone C2-20 (hDHFR (N186D)), Clone C1-24 (hDHFR (V110A, V136M, K177R)), Clone C2-25 (hDHFR (E162G, I176F)), Clone C3-3 (hDHFR (M140I)), and Clone C3-9 (hDHFR (H131R, E144G)). Among these mutants, Clone C3-3 (hDHFR (M140I)), and Clone C1-21(hDHFR (K185E)) also showed low GFP expression levels with DMSO treatment at levels comparable to the parental untransfected NIH3 T3 cells indicating a high degree of destabilization in the absence of ligand of mutants showed low GFP intensity. Another group of hDHFR mutants showed low GFP intensity compared to WT with DMSO treatment and high GFP intensity only with MTX but not TMP, suggesting that the mutants are destabilized in the absence of MTX, but are stabilized in the presence of MTX. Mutants that showed MTX dependent stability include Clone C1-18 (hDHFR (V9A, S93R, P150L)), Clone C2-21(hDHFR (A10V, H88Y)), Clone C2-8 (hDHFR (I8V, K133E, Y163C)), Clone C2-15 (hDHFR (K19E, F89L, E181G)), Clone C2-8 (hDHFR (I8V, K133E, Y163C)), Clone C2-15 (hDHFR (K19E, F89L, E181G)), Clone C3-1(hDHFR (Y178H, E181G)), Clone C3-22 (hDHFR (T57A, I72A)), Clone C3-10 (hDHFR (Y183H, K185E)), and Clone C4-3 (hDHFR (G21E, I72V, I176T)). A third behavior observed in some of the hDHFR mutants included low GFP expression with DMSO treatment and no subsequent increase in GFP intensity with MTX or TMP treatment indicating that the mutations may be severely destabilizing. hDHFR mutants that were only destabilized include Clone C1-10 (hDHFR (C7R, Y163C)), Clone C1-25 (hDHFR (T137R, F143L)), Clone C2-22 (hDHFR (G54R, I115L, M140V, S168C)), Clone C2-23 (hDHFR (L23S, V121A, Y157C)), and Clone C3-2(hDHFR (N49D, F59S, D153G)). A fourth group of hDHFR mutants showed GFP expression levels with DMSO treatment that was comparable to the wildtype DHFR, with a further increase in GFP intensity with TMP and MTX treatment suggesting that these mutations were only capable of stabilizing hDHFR. Examples of stabilizing mutants include Clone C1-11 (hDHFR (N65D)), and Clone C1-12 (hDHFR(K81R)).

Example 4. hDHFR C Terminus Fusion Proteins

DDs may be positioned upstream or downstream of the payload within an SRE. hDHFR mutants generated by structure guided mutagenesis as discussed in example 2 were fused at the C-terminus of GFP to test if the hDHFR mutants can destabilize proteins of interest when fused to the C-terminus of the protein of interest. A linker, GGSGGG (SEQ ID NO. 6413) was placed between GFP and hDHFR and cloned into pLVX.IRES. Puro.

Figure 20A:
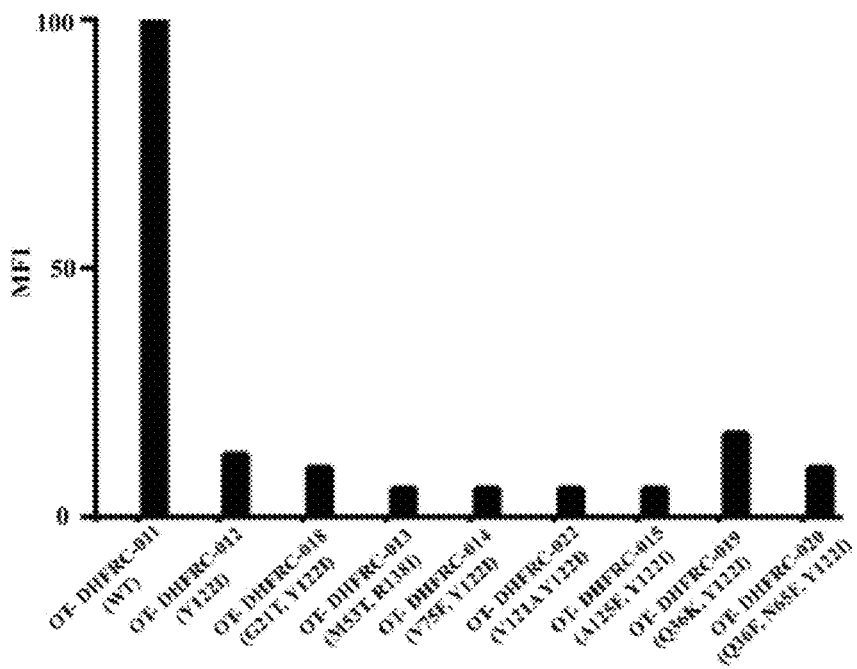
FIG. 20A-FIG. 20B show GFP intensity of hDHFR mutants.
Figure 20B:
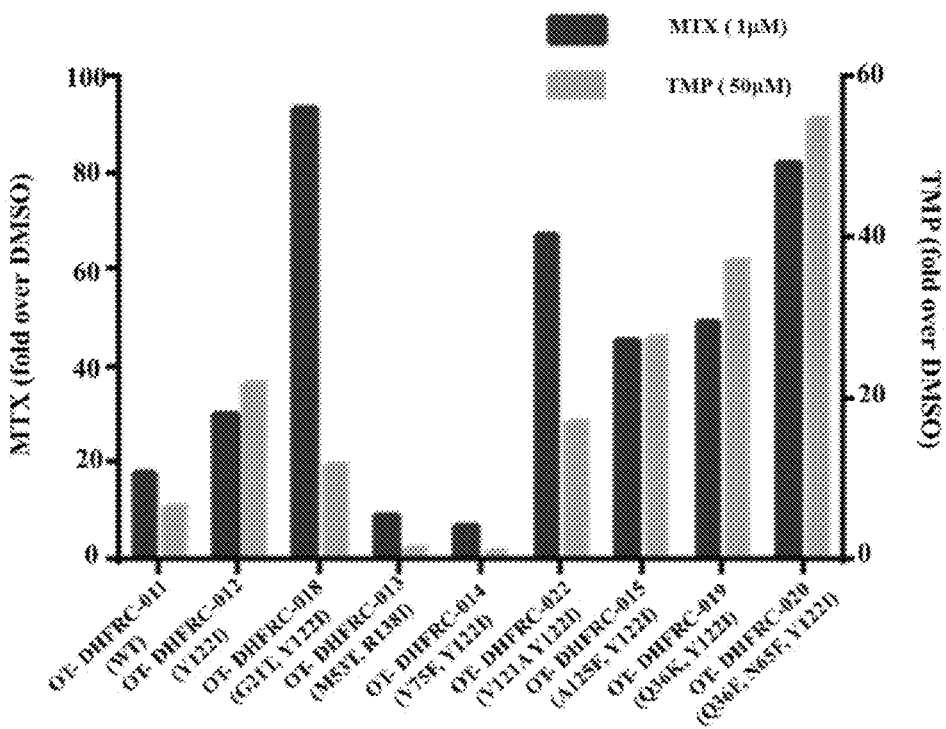

HEK 293T cells stably expressing GFP-hDHFR-WT or GFP-hDHFR(mutant) constructs were incubated with 1 µM MTX or 50 µM TMP or DMSO (control) for 48 hours. Following the incubation, median fluorescence intensity (MFI) was measured using FACS. All hDHFR(mutant)-GFP constructs demonstrated lower MFI intensities compared to hDHFR WT, suggesting a significant destabilization in the absence of the ligand (FIG. 20A). Mutants OT-hDHFRC-012 (hDHFR (Y122I), OT-hDHFRC-015 (hDHFR (A125F, Y122I), OT-hDHFRC-019 (hDHFR (Q36K, Y122I), and OT-hDHFRC-020, and (hDHFR (Q36F, N65F, Y122I) showed a several fold increase in MFI over DMSO with both MTX and TMP treatment suggesting that these constructs can be stabilized by both ligands. While OT-hDHFRC-018 (hDHFR (G21T, Y122I), OT-hDHFRC-022 (hDHFR V121A, Y122I) showed a fold increase in MFI over DMSO only with MTX suggesting a MTX dependent stabilization (FIG. 20B). These data show that human DHFR derived destabilizing domains can destabilize GFP when fused to C terminus.

Example 5. Mutant hDHFR Ligand-Binding Characteristics

Figure 21A:
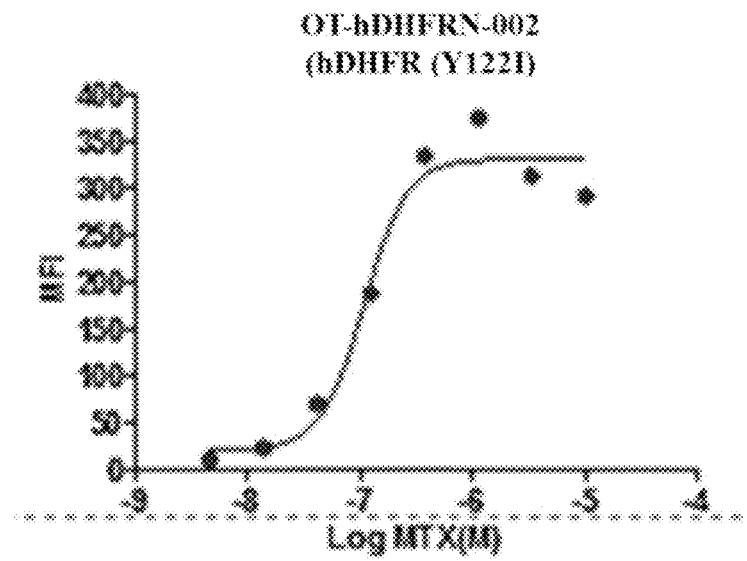
FIG. 21A-FIG. 21B show MTX or TMP titration with hDHFR mutants.

The binding of hDHFR mutants to varying doses of ligands was characterized using DHFR mutants fused to N terminus of AcGFP. HEK293 cells stably expressing OT-hDHFRN-002 (hDHFR(Y122I)-GFP) construct were incubated with varying concentrations of MTX or DMSO in DMEM with 10% FBS for 48 hrs. Median GFP fluorescence intensity was measured using FACS analysis. hDHFR (Y122I) mutant showed a ligand dose dependent increase in GFP intensity (FIG. 21A). This data suggests that hDHFR (Y122I) was stabilized by MTX in a dose dependent manner. Since MTX is also an inhibitor of DHFR, the IC50 was also calculated and an $IC_{50}$ of 108 nM was obtained.

Figure 21B:
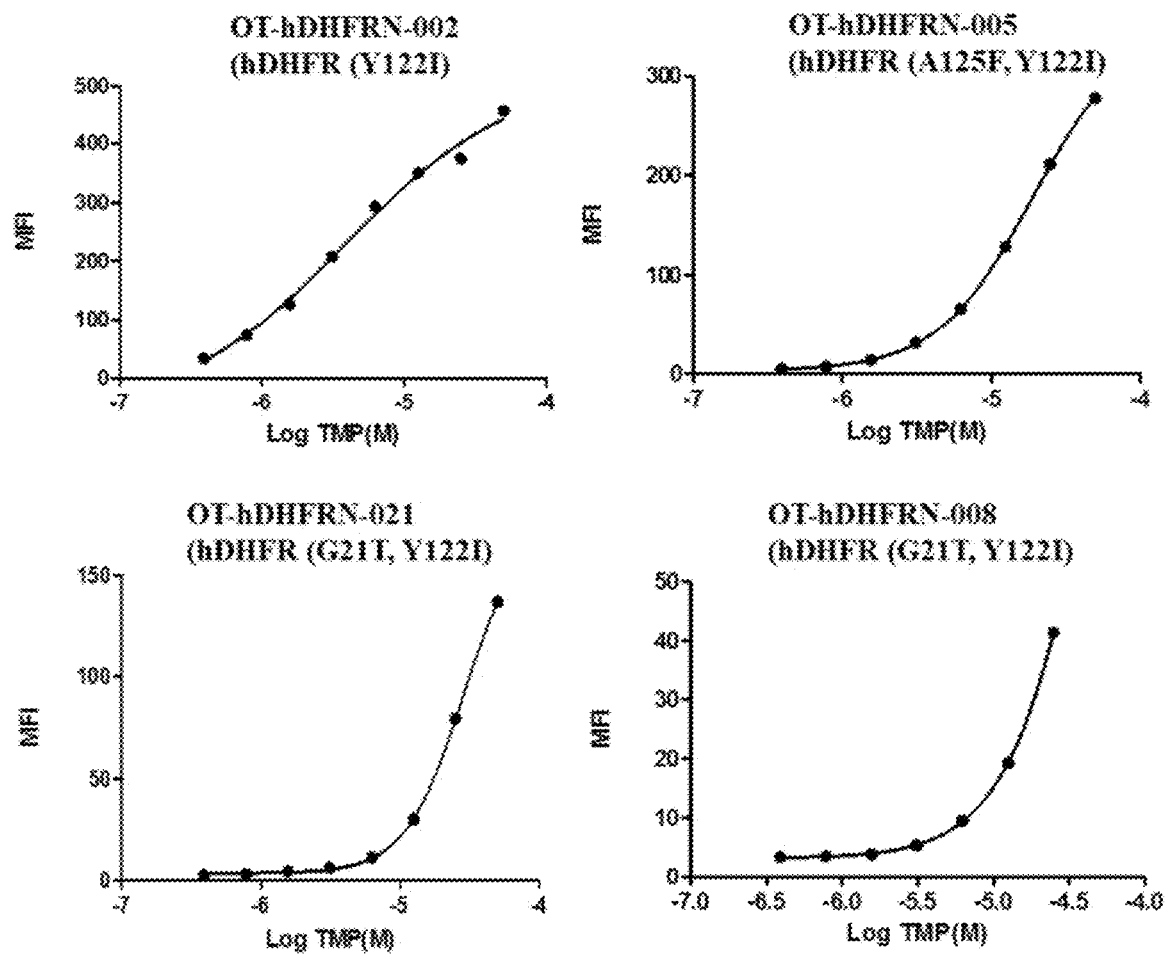

HEK293 cells stably expressing OT-hDHFRN-002 (hDHFR(Y122I)-GFP), OT-hDHFRN-005 (hDHFR (A125F, Y122I)), OT-hDHFRN-008 (hDHFR (G21T, Y122I)) and OT-hDHFRN-021 (hDHFR (V121A, Y122I)) constructs were incubated with varying concentrations of TMP or DMSO in DMEM with 10% FBS for 48 hrs. Mean GFP fluorescence intensity was measured using FACS analysis (FIG. 21B). All mutants showed ligand dose dependent increase in GFP intensity suggesting an increase in TMP dependent stabilization of the hDHFR mutants.

Since TMP is also an inhibitor of DHFR, the $IC_{50}$ was also calculated for each of the mutants and is shown in Table 51.

TABLE 51 hDHFR ligand binding affinity

| Construct ID. | Construct | $IC_{50}$ (µM) |
|---|---|---|
| OT-hDHFRN-002 | pLVX-hDHFR(Y122I). AcGFP-IRES-Puro | 3.841 |
| OT-hDHFRN-005 | pLVX-hDHFR (A125F, Y122I). AcGFP-IRES-Puro | 18.89 |
| OT-hDHFRN-008 | pLVX-hDHFR (G21T, Y122I). AcGFP-IRES-Puro | 57.1 |
| OT-hDHFRN-021 | pLVX-hDHFR (V121A, Y122I). AcGFP-IRES-Puro | 28.7 |

As shown in Table 51, all mutants showed an IC50 at the micromolar concentrations of TMP.

Figure 22:
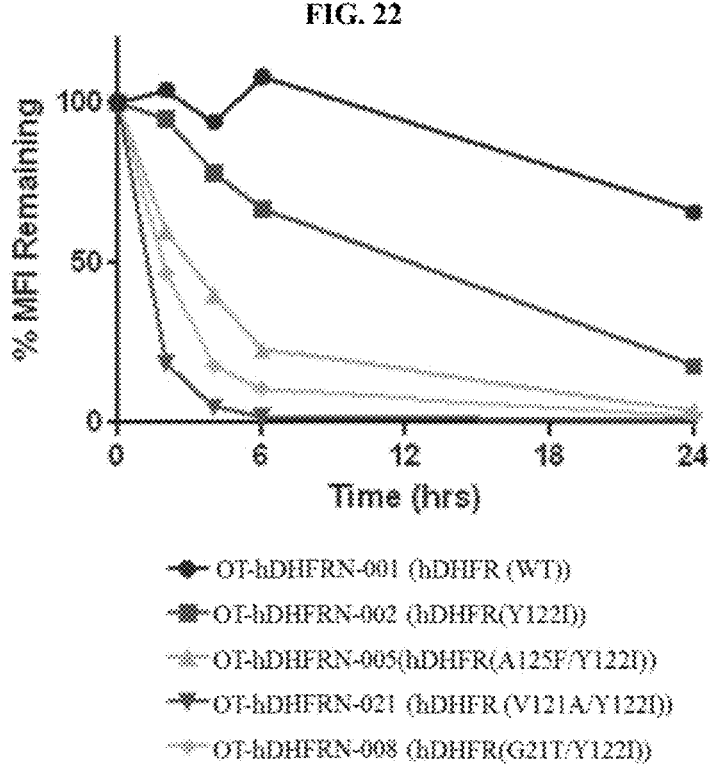
FIG. 22 shows responsiveness of hDHFR mutants to ligand withdrawal as measured by FACS.

The kinetics of destabilization of the human DHFR mutants following ligand dependent stabilization was assessed after ligand withdrawal. The wildtype human DHFR construct (OT-hDHFRN-001) and the four DHFR mutants tested i.e. OT-hDHFRN-002(hDHFR(Y122I)), OT-hDHFRN-005 (hDHFR (A125F, Y122I)), OT-hDHFRN-021 (hDHFR (V121A, Y122I)) and OT-hDHFRN-008 (hDHFR (G21T, Y122I)) were tested in this context. HEK293 cells stably expressing hDHFR-WT or hDHFR mutant constructs were incubated with 50 µM TMP in DMEM with 10% FBS for 48 hours. Following incubation, cells were washed with DMEM containing 10% FBS. DMEM containing 1 µg/mL recombinant human DHFR protein was added to the cells and were further incubated for 2, 4, 6 or 24 hours. Median fluorescence intensity of the cells was measured using FACS and compared to the median fluorescence intensity of cells before incubation with the recombinant human DHFR (time 0). The results are depicted as the percentage of median fluorescence intensity (MFI) of GFP remaining after time 0 (FIG. 22). All mutants showed a decrease in % MFI over time with virtually no signal detected at 24 hours. As expected, the wildtype human DHFR construct did not show a decrease in fluorescence intensity over time. These data show that each mutant has a unique profile with respect to the time course of destabilization and GFP can be almost completely destabilized by mutants following ligand withdrawal.

Example 6. In Vivo TMP Pharmacokinetics

To test TMP pharmacokinetics in vivo, Balb/C nu/nu mice were dosed with one of three different concentrations of TMP 30 mg/kg, 100 mg/kg, or 300 mg/kg TMP. The concentration of TMP in the plasma was measured at 0.083 hours, 0.25 hours, 0.5 hours, 1 hour, 2 hours, 4 hours, 8 hours, 12 hours, 16 hours, 20 hours, and 24 hours after dosing. The plasma TMP levels at different time points are presented in Table 52.

TABLE 52

Plasma TMP levels

| Time (hrs) | 300 mg/kg TMP | 100 mg/kg TMP | 30 mg/kg TMP |
|---|---|---|---|
| 0.083 | 116.77 | 81.55 | 25.67 |
| 0.25 | 136.92 | 78.10 | 19.55 |
| 0.5 | 128.05 | 58.79 | 9.84 |
| 1 | 80.00 | 27.59 | 2.55 |
| 2 | 32.63 | 2.97 | 1.19 |
| 4 | 1.03 | 0.99 | 0.16 |
| 8 | 0.30 | 0.56 | 0.04 |
| 24 | 0.01 | 0.01 | not measured |

100 mg/kg resulted in TMP concentrations in the plasma of 50-100 µM at the early time points and 300 mg/kg dose resulted in 100-150 µM plasma concertation of TMP at early time points. Virtually no TMP levels were detected in the plasma 4 hours after dosing. Thus 100 mg/kg represents the lowest dose that results in significant plasma concentrations of TMP that may be required for human DHFR stabilization in vivo.

Example 7. Human DHFR Regulated Expression of IL15-IL15Ra Fusion Molecule

A fusion molecule was generated by fusing membrane bound IL15, IL15 Receptor alpha subunit (IL15Ra) and human DHFR (DD). These fusion molecules were cloned into pLVX-EF1a-IRES-Puro vector.

Membrane bound-IL15-IL15Ra constructs (OT-IL15-008 to OT IL-15-011) were transduced into human colorectal carcinoma cell line, HCT-116 and stable integrants were selected with 2 µg of puromycin. Stably integrated cells were incubated for 24 hours in the presence or absence of 10 µM Trimethoprim or 1 µM Methotrexate.

Surface expression of IL15-IL15Ra fusion constructs was examined by staining with PE-conjugated IL15Ra antibody (Cat no. 330207, Biolegend, San Diego, Calif.). The median fluorescence intensity obtained with the different constructs in the presence or absence of the corresponding ligand is presented in Table 53. The stabilization ratio was calculated as the fold change in fluorescence intensity in ligand treated samples compared to treatment with DMSO (i.e. in the absence of ligand) with the same construct. The destabilization ratio was calculated as the fold change in fluorescence intensity in the DD regulated constructs compared to the constitutive construct (OT-IL15-008) in the absence of the ligand. Destabilization ratios less than 1 and stabilization ratios greater than 1 are desired in DDs.

TABLE 53

Surface expression of IL15-IL15Ra fusion constructs

| Construct | Median Fluorescence Intensity | | | Destabilization ratio | Stabilization ratio | |
|---|---|---|---|---|---|---|
| | DMSO | 10 µM TMP | 1 µM MTX | | TMP | MTX |
| HCT-116 cells (control) | 273 | — | — | — | — | — |
| OT-IL15-008 (Constitutive) | 5315 | 7019 | — | 19.47 | 1.32 | |
| OT-IL15-010 (hDHFR (Y122I, A125F)) | 2657 | 5775 | 15864 | 3.48 | 2.17 | 5.97 |
| OT-IL15-011 (hDHFR (Q36F, N65F, Y122I)) | 1560 | 4010 | 14509 | 0.59 | 2.57 | 9.30 |

Cells transduced with IL-15-IL15Ra fused to human DHFR constructs showed lower fluorescence intensity than the constitutive construct with DMSO treatment. Addition of TMP resulted in an increase in fluorescence with all constructs. Destabilization ratios less than one was observed with OT-IL 15-011(hDHFR (Q36F, N65F, Y122I)) indicating a strong destabilization in the absence of ligand. Stabilization ratio greater than 1 was observed with all constructs with TMP treatment and with both OT-IL15-010 and 11 with MTX treatment. These data show that OT-IL15-011 is both strongly destabilized in the absence of ligand and strongly stabilized in the presence of ligand.

Figure 23:
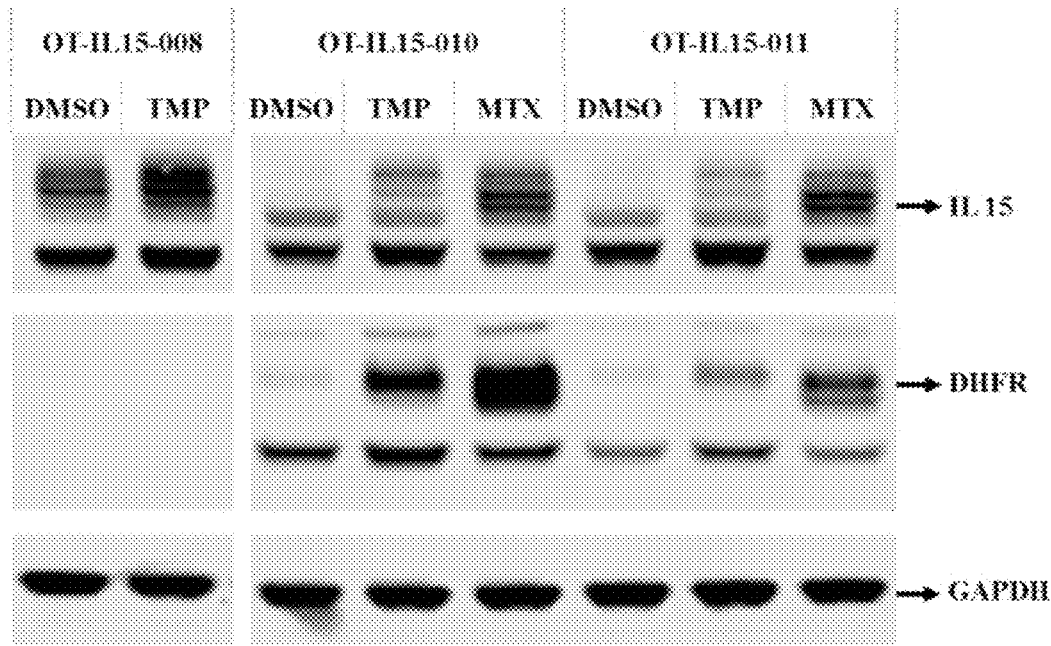
FIG. 23 shows hDHFR-IL15/IL15Ra fusion protein expression in a western blot using anti IL15 and anti hDHFR antibodies.

To further confirm expression and ligand-dependent stabilization of IL15-IL15Ra constructs (OT-IL15-008, OT-IL15-010, OT-IL15-011) in HCT-116, cells were incubated with 10 µM Trimethoprim or 1 µM Methotrexate or DMSO for 24 hours. Following incubation, cells were harvested and cell extracts were prepared. Cell extracts were run on SDS-PAGE and western blotted with anti-IL15 antibody (Catalog No. 7213, Abcam, Cambridge, UK). As shown in FIG. 23, the IL15/IL15Ra constitutive construct (OT-IL15-008) showed ligand independent IL15 expression while the DD regulated constructs (OT-IL15-0010 and OT-IL15-011) showed ligand dependent IL15 expression. The identity of the IL15 bands was also confirmed by immunoblotting with the anti-human DHFR antibody (Catalog No. 117705, Genetex, Irvine, Calif.). Both IL15-IL15Ra fusion constructs (OT-IL15-010 and 011) showed ligand dependent expression of DHFR expression.

Example 8. Ligand Dependent Expression of DD IL15-IL15Ra Fusion Molecule

To evaluate the dependence of ligand induced stabilization on the dose of the ligand, IL15-IL15Ra fusion constructs namely, OT-IL15-008, OT-IL15-010 (hDHFR (Y122I, A125F)), and OT-IL15-011 (hDHFR (Q36F, N65F, Y122I)) were stably transduced into HCT-116 cells and incubated with increasing concentrations of Trimethoprim for 24 hours. Surface expression of IL15-IL15Ra fusion constructs was quantified by FACS using IL15Ra-PE antibody. The median fluorescence intensity with increasing doses of TMP is represented in Table 54.

TABLE 54

Surface expression of IL15-IL15Ra fusion constructs

| | Median Fluorescence Intensity | |
|---|---|---|
| Dose (µM) | hDHFR (Y122I, A125F) | hDHFR (Q36F, N65F, Y122I) |
| DMSO | 3034 | 2357 |
| 0.01 | 2791 | 2291 |
| 0.02 | 2833 | 2216 |
| 0.05 | 2924 | 2054 |
| 0.14 | 2740 | 2150 |
| 0.41 | 2817 | 2400 |
| 1.23 | 2890 | 2251 |
| 3.7 | 3117 | 2494 |
| 11.11 | 3473 | 2841 |
| 33.33 | 4019 | 3409 |
| 100 | 5227 | 4592 |

As shown in Table 54, all three constructs showed a dose dependent increase in median fluorescence intensity indicating a dose dependent increase in surface expression of IL15-IL15Ra fusion upon addition of DD stabilizing ligand.

Example 9. DD Regulated Expression of IL15-IL15Ra Fusion Molecule

A fusion molecule is generated by fusing membrane bound hL15, IL15 Receptor alpha subunit (IL15Ra) and DDs such as ecDHFR (DD), FKBP (DD), or human DHFR (DD). These fusion molecules were cloned into pLVX-EF1a-IRES-Puro vector.

Figure 24A:
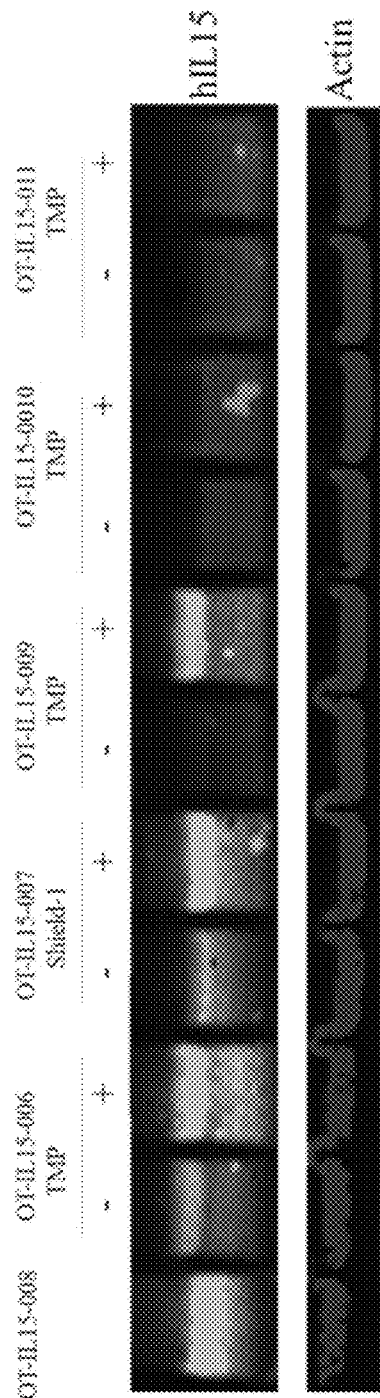
FIG. 24A-FIG. 24D show IL15 protein levels and surface expression of IL15 and IL15Ra.

To test ligand dependent IL15-IL15Ra production, 1 million HEK-293T cells were plated in a 6-well plate in growth media containing DMEM and 10 FBS and incubated overnight at 37° C., 5% CO2. Cells were then transfected with 100 ng of constitutive IL15-IL15Ra (OT-IL15-008) or DD linked IL15-IL15Ra (OT-IL15-006, OT-IL15-007, OT-IL15-009, OT-IL15-010, OT-IL15-011) using Lipofectamine 2000 and incubated for 24 hrs. Following the incubation, media is exchanged for growth medium with or without 10 µM Trimethoprim or 1 µM Shield-1 and further incubated for 24 hrs. Cells were harvested and IL15 levels are analyzed via western blotting using human IL15 antibody (Abcam, Cambridge, UK). OT-IL15-009 showed the strong ligand (Trimethoprim) dependent stabilization of IL15, while OT-IL15-006 and OT-IL15-007 showed modest ligand dependent stabilization of IL15 (FIG. 24A).

Figure 24B:
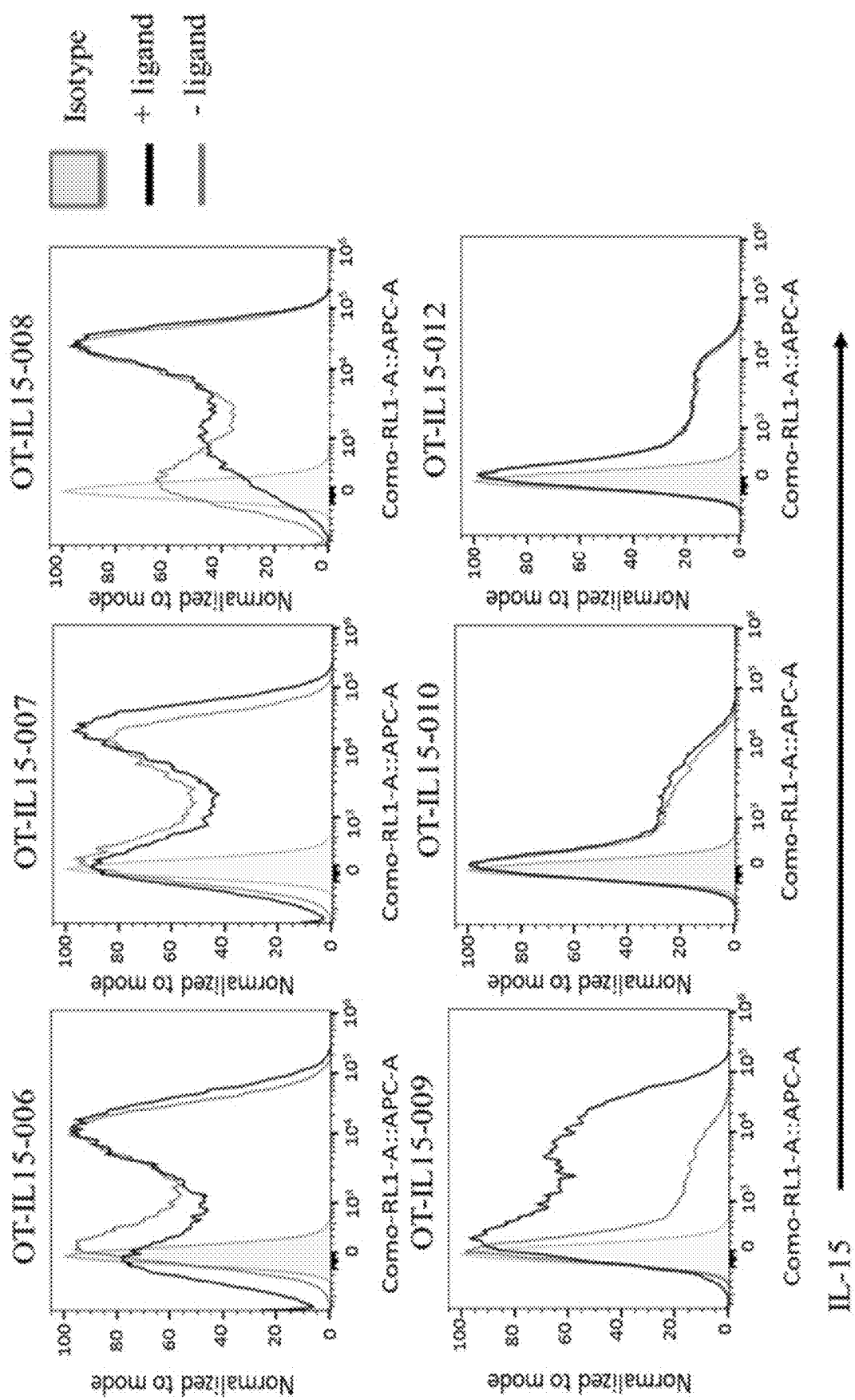
Figure 24C:
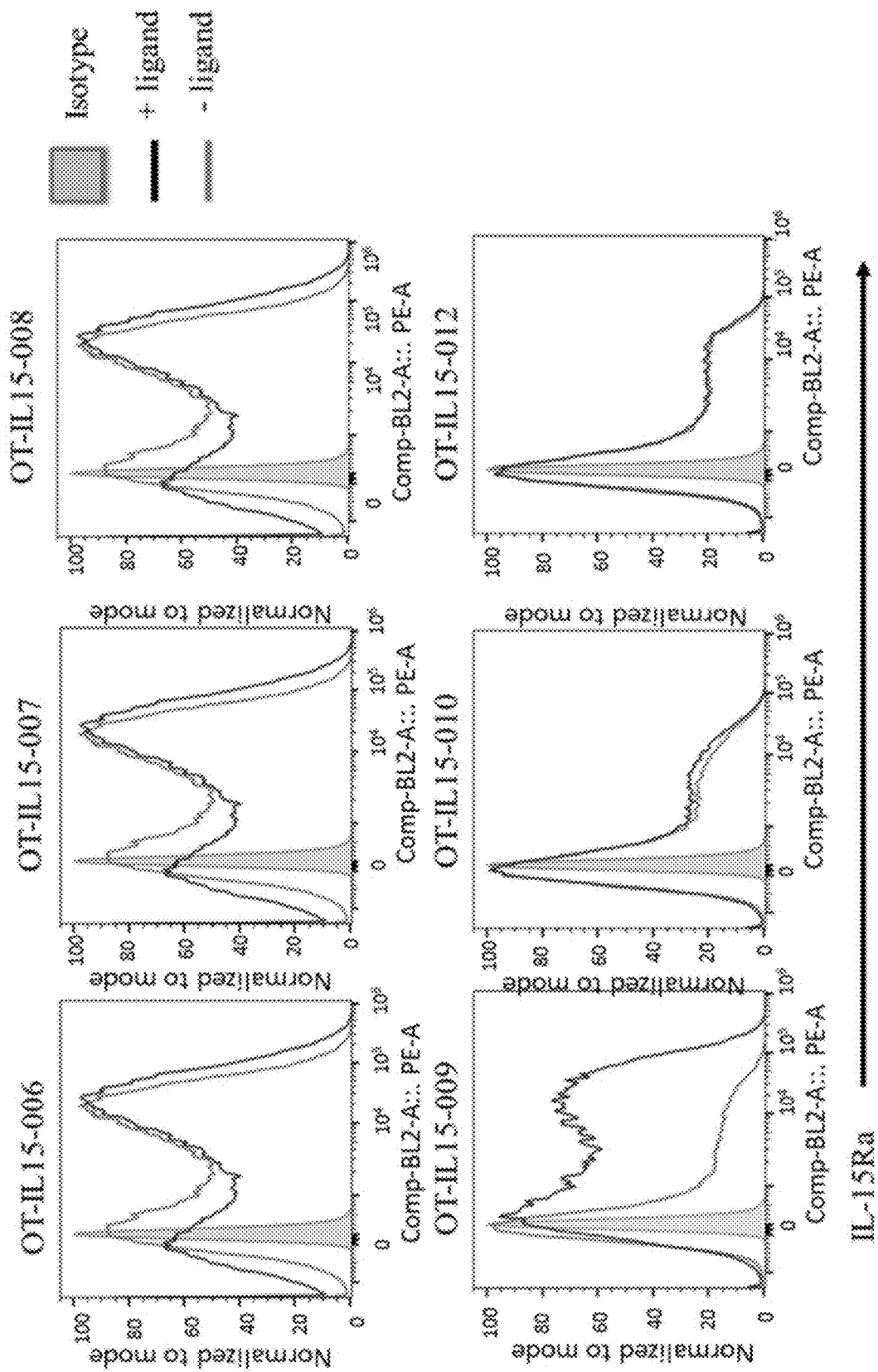

Surface expression of membrane bound IL15-IL15Ra constructs (OT-IL15-006, OT-IL15-007, OT-IL15-008, OT-IL15-009, OT-IL15-010, OT-IL15-011) was determined by FACS using anti-IL15 and anti-IL15Ra antibodies. HEK293T cells were transfected with IL15-IL15Ra constructs and then treated with suitable ligand (Shield-1 or Trimethoprim). 48 hours after transfection, cells were analyzed using FACS. As expected, constitutive IL15-IL15Ra construct OT-IL15-008 showed high surface expression of IL15 and IL15Ra both in the presence and absence of ligand. Consistent with the results from the western blot, OT-IL15-009 showed the strong ligand (Trimethoprim) dependent surface expression of IL15 and IL15Ra (FIG. 24B, FIG. 24C).

Membrane bound-IL15-IL15Ra constructs (OT-IL15-008 to OT IL15-011) were transduced into human colorectal carcinoma cell line, HCT-116 and stable integrants were selected with 2 μg of puromycin. Stably integrated cells were then incubated for 24 hours in the presence or absence of 101 μM Trimethoprim or 1 μM Methotrexate.

Surface expression of IL15-IL15Ra fusion constructs was examined by staining with PE-conjugated IL15Ra antibody (Cat no. 330207, Biolegend, San Diego, Calif.). The median fluorescence intensity obtained with the different constructs in the presence or absence of the corresponding ligand is presented in Table 55.

TABLE 55

Surface expression of IL15-IL15Ra fusion constructs

| Construct | Median Fluorescence Intensity | | |
|---|---|---|---|
| | DMSO | 10 μM TMP | 1 μM MTX |
| HCT-116 cells (control) | 273 | | |
| OT-IL15-008 (Constitutive) | 5315 | 7019 | |
| OT-IL15-006 (ecDHFR (R12Y, E129K) | 764 | 2978 | |
| OT-IL15-010 (hDHFR (Y122I, A125F)) | 2657 | 5775 | 15864 |
| OT-IL15-011(hDHFR (Q36F, N65F, Y122I)) | 1560 | 4010 | 14509 |

The stabilization ratio was calculated as the fold change in GFP intensity in ligand treated samples compared to treatment with DMSO (i.e. in the absence of ligand) with the same construct. The destabilization ratio was calculated as the fold change in GFP intensity in the DD regulated constructs compared to the constitutive construct (OT-IL15-008) in the absence of the ligand. Destabilization ratios less than 1 and stabilization ratios greater than 1 are desired in DDs. The ratios are presented in Table 56.

TABLE 56

IL15-IL15Ra destabilization and stabilization ratios

| Construct | Destabi-lization ratio | Stabilization ratio | |
|---|---|---|---|
| | | TMP | MTX |
| OT-IL15-008 (Constitutive) | 19.47 | 1.32 | |
| OT-IL15-006 (ecDHFR (R12Y, E129K)) | 0.14 | 3.90 | — |
| OT-IL15-010 (hDHFR (Y122I, A125F)) | 3.48 | 2.17 | 5.97 |
| OT-IL15-011(hDHFR (Q36F, N65F, Y122I)) | 0.59 | 2.57 | 9.30 |

Destabilization ratios less than one was observed with OT-IL15-006 (ecDHFR (R12H, E129K)) and OT-IL 15-011 (hDHFR (Q36F, N65F, Y122I)) indicating a strong destabilization in the absence of ligand. Stabilization ratio greater than 1 was observed with all constructs with TMP treatment and with both OT-IL15-010 and 11 with MTX treatment. These data show that OT-IL15-006 and OT-IL15-011 are both strongly destabilized in the absence of ligand and strongly stabilized in the presence of ligand.

Figure 24D:
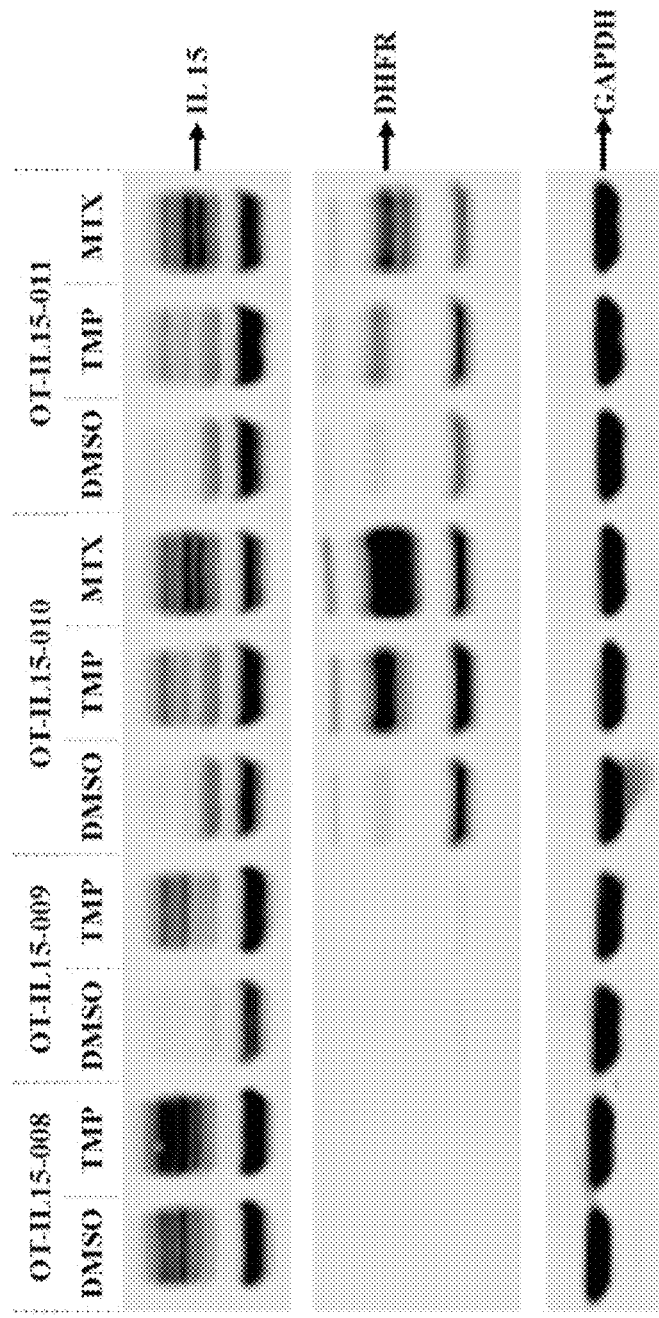

The expression and ligand-dependent stabilization of IL15-IL15Ra constructs (OT-IL15-008 to OT-IL15-011) was measured in HCT-116. Cells were incubated with 10 μM Trimethoprim or 1 μM Methotrexate or DMSO for 24 hours. Following incubation, cells were harvested and cell extracts were prepared. Cell extracts were run on SDS-PAGE and western blotted with anti-IL15 antibody (Catalog No. 7213, Abcam, Cambridge, UK). As shown in FIG. 24D, the IL15/IL15Ra constitutive construct (OT-IL15-008) showed ligand independent IL15 expression while the DD regulated constructs (OT-IL15-009 to OT-IL15-011) showed ligand dependent IL15 expression. The identity of the IL15 bands was also confirmed by immunoblotting with the anti-human DHFR antibody (Catalog No. 117705, Genetex, Irvine, Calif.). As shown in FIG. 24D, both IL15-IL15Ra fusion constructs (OT-IL15-010 and 011) showed ligand dependent expression of DHFR expression.

To evaluate the dose dependence of ligand induced stabilization, IL15-IL15Ra fusion constructs namely, OT-IL15-009 (ecDHFR (R12Y, Y100I)), OT-IL15-010 (hDHFR (Y122I, A125F)), and OT-IL15-011 (hDHFR (Q36F, N65F, Y122I)) were stably transduced into HCT-116 cells and incubated with increasing concentrations of Trimethoprim for 24 hours. Surface expression of IL15-IL15Ra fusion construct was quantified by FACS using IL15Ra-PE antibody. The median fluorescence intensity with increasing doses of TMP is represented in Table 57.

TABLE 57

Surface expression of IL15-IL15Ra

| Dose (μM) | Median Fluorescence Intensity | | |
|---|---|---|---|
| | ecDHFR (R12Y, Y100I) | hDHFR (Y122I, A125F) | hDHFR (Q36F, N65F, Y122I) |
| DMSO | 1260 | 3034 | 2357 |
| 0.01 | 1384 | 2791 | 2291 |
| 0.02 | 1492 | 2833 | 2216 |
| 0.05 | 1947 | 2924 | 2054 |
| 0.14 | 2741 | 2740 | 2150 |
| 0.41 | 3360 | 2817 | 2400 |
| 1.23 | 4014 | 2890 | 2251 |
| 3.7 | 4265 | 3117 | 2494 |
| 11.11 | 4267 | 3473 | 2841 |
| 33.33 | 4485 | 4019 | 3409 |
| 100 | 4633 | 5227 | 4592 |

As shown in Table 57, all three constructs showed a dose dependent increase in median fluorescence intensity indicating a dose dependent increase in surface expression of IL15-IL15Ra fusion upon addition of DD stabilizing ligand.

The time course of ligand dependent stabilization of IL15-IL15Ra fusion constructs was measured in HCT-116 cells. Cells were transduced with OT-IL15-009 (ecDHFR (R12Y, Y100I) construct and incubated with 10 μM Trimethoprim for 0, 12, 16, 24, 48 or 72 hours. Following incubations, surface expression of IL15-IL15Ra fusion construct was quantified by FACS using IL15Ra-PE antibody and compared to parental untransfected cells. The median fluorescence intensity (MFI) over time is represented in Table 58.

TABLE 58

Time course of IL15-IL15Ra surface expression

| Time (hours) | MFI |
| --- | --- |
| Parental | 3054 |
| 0 | 4004 |
| 12 | 7054 |
| 16 | 9390 |
| 24 | 14056 |
| 48 | 28644 |
| 72 | 35303 |

As shown in Table 58, OT-IL15-009 (ecDHFR (R12Y, Y100I) showed a time-dependent increase in median fluorescence intensity indicating that the surface expression of IL15-IL15Ra fusion increased with increased duration of treatment with DD stabilizing ligand.

Example 10. Predicting Novel DDs Based on DHFR Mutagenesis Data

Human DHFR mutants generated by site directed and random mutagenesis were compared with wildtype human DHFR protein sequence and analyzed for patterns. Exemplary alignments are shown in FIG. 25A, and FIG. 25B. The analysis of the sequences showed that many hDHFR DDs mutations match a vicinal amino acid, located up to 5 amino acids upstream or downstream of the mutation site. The human DHFR mutants that have been mutated to the immediately upstream or downstream wildtype amino acid are listed in Table 59.

TABLE 59

DHFR mutant analysis

| hDHFR mutant | Vicinal amino acid and location |
| --- | --- |
| I8V | 9V |
| V9A | A10 |
| A10V | V9 |
| Q36F | F35 |
| F59S | S60 |
| L74N | N73 |
| F89L | L90 |
| S93R | R92 |
| T137R | R138 |
| R138I | I139 |
| M140I | I139 |
| K185E | E184 |
| N186D | D187 |

The human DHFR mutants that have been mutated to the wildtype amino acid that is two to five amino acids upstream or downstream of the position of the mutation are listed in Table 60.

TABLE 60

DHFR mutant analysis

| hDHFR mutant | Vicinal wildtype amino acid and location |
| --- | --- |
| I72V | V75 |
| L94A | L98 |
| A107V | V110 |
| V110A | A107 |

TABLE 60-continued

DHFR mutant analysis

| hDHFR mutant | Vicinal wildtype amino acid and location |
| --- | --- |
| V121A | A125 |
| N127Y | Y122 |
| V136M | M140 |
| M140V | V136 |
| P150L | L154 |
| I176F | F180 |
| Y183H | Y178 |

Example 11. Characterization of hDHFR Mutants Using Thermal Shift Assays

Thermal shift assays can be used to measure the thermal denaturation temperature of a protein as an indicator of its stability in response to different conditions such as pH, ions, salts, additives, drugs, and/or mutations. It can also be used to determine conditions under which protein stabilization or destabilization can be maximized. Human DHFR mutants are mixed with a thermal assay dye, thermal assay buffer, and ligand (or DMSO control). Samples are also treated with varying concentrations of factors such as drugs, salts, ions, or other parameters. The samples are loaded into an instrument such as a real-time PCR instrument and the temperature ramp rates is set within a range of approximately 0.1-10 degrees Celsius per minute. The fluorescence in each condition is measured at regular intervals, over a temperature range spanning the typical protein unfolding temperatures of 25-95 degrees Celsius.

Example 12. DD Regulated Recombinant IL12 Expression

DHFR (DD)-IL12 constructs are packaged into pLVX-IRES-Puro lentiviral vectors with CMV, EF1a, PGK or without a promoter. hDHFR (Q36F, Y122I, A125F (OT-IL12-008) or the constitutive construct (OT-IL12-006) and cloned into a pLVX-CMV-IRES-Puro. A p40 signal sequence was inserted at the N terminus of the construct and a furin protease cleavage site or a modified furin site was also included (see Table 38).

HEK293T cells are transiently or stably transfected, or stably transduced with IL12 constructs (OT-IL12-006, and OT-IL12-008), and subsequently treated with Trimethoprim, or Methotrexate, or left untreated for 6 hours. Culture media is collected from transfected cells and diluted 1:50 to measure IL12 levels using p40 ELISA. Treatment with ligand is expected to result in a significant increase in IL12 over untreated control.

To evaluate ligand (MTX or TMP) dependent IL12 induction over time, 2 million cells e.g. HEK 293T cells are plated in growth medium and incubated overnight in the presence of TMP or MTX, or left untreated. Cells are then incubated for additional time ranging from 2 to 72 hours and growth media is collected from the cells at all time points. Growth media is diluted 400-fold and IL12 levels are measured using IL12 p40 ELISA. IL12 expression in ligand treated cells is expected to increase over time.

Example 13. DD Regulated CD19 CAR

A CD19 CAR fusion polypeptide was linked to the N terminus of human DHFR derived DDs (as shown in Table 11) and the constructs are cloned into pLVX-IRES-Puro vector.

To test ligand dependent expression of DD-CD19 CAR constructs, 1 million HEK 293T cells are cultured in growth medium containing DMEM and 10% FBS and transfected with CAR constructs using Lipofectamine 2000. 48 hours after transfection, cells are treated 101 µM Trimethoprim or vehicle control and incubated further for another 24 hours. Cells are then harvested, lysed and immunoblotted for CD3 Zeta using anti-CD247 (BD Pharmingen, Franklin Lanes, N.J.) and Alexa 555-conjugated-goat-anti mouse antibody (red) (Li-Cor, Lincoln, Nebr.). Lysates are also immunoblotted for Actin with Alexa 488-conjugated secondary antibody (green) to confirm even protein loading across all samples. Compared to the untreated control, TMP treated human DHFR mutant CD19 CAR constructs (OT-CD19C-008 to OT-CD19C-011) are expected to show an increase in CD3 Zeta protein levels in the presence of TMP indicating the stabilization of the CD19 CAR.

Surface expression of CD19 CAR-hDHFR constructs in HEK 293T cells is measured using FACS with Protein L-Biotin-Streptavidin-Allophycocyanin which binds to the kappa light chain of the CAR (ThermoFisher Scientific, Waltham, Mass.). Cells are treated with 10 µM Trimethoprim or 1 µM MTX, or vehicle control for 24 hours and subject to FACS analysis. Surface expression of CD19 CAR-hDHFR constructs is expected to be detected only in the presence of ligand.

Example 14. Trimethoprim Versus Methotrexate Binding Determinants

The affinity of DHFR mutants identified by random mutagenesis for ligands TMP and MTX was tested. HEK293T cells expressing mutants were treated with varying concentrations of TMP or MTX and GFP intensity was measured using FACS. The ligand binding potential of the mutants was also compared to the wildtype DHFR in the same experiment. The results are presented in Table 61 for Methotrexate and in Table 62 for Trimethoprim. The percentage normalized response was obtained by subtracting the background fluorescence intensity from the fluorescence intensity obtained with each sample. The values were then normalized to the fluorescence intensity obtained with the 100 µM of ligand. In Table 61 and Table 62, the percentage normalized values obtained for the mutants was greater than the wildtype protein at that concentration of ligand.

TABLE 61

Methotrexate binding analysis

| | | % Normalized Response | | | | |
|---|---|---|---|---|---|---|
| MTX (µM) | hDHFR (WT) | Clone C1-3 (hDHFR (A107V)) | Clone C1-4 (hDHFR (F59S)) | Clone C1-8 (hDHFR (I17V)) | Clone C1-14 (hDHFR (N127Y)) | Clone C1-25 (hDHFR (K185E)) |
| 100 | 100 | 100 | 100 | 100 | 100 | 100 |
| 33.333 | 90.82 | 139.6 | 161.79 | 60.9 | 54.12 | 87.71 |
| 11.111 | 79.16 | 98.85 | 113.46 | 51.03 | 40.32 | 55.64 |
| 3.704 | 60.09 | 69.01 | 54.34 | 37.52 | 35.37 | 7.27 |
| 1.235 | 31.13 | 33.21 | 21.1 | 10.65 | 1.65 | 1.41 |
| 0.412 | −9.04 | 5.21 | 2.52 | 0.32 | −0.21 | 0.15 |
| 0.137 | −9.02 | −3.52 | −0.12 | −0.09 | −0.51 | −0.05 |
| 0.046 | −6.07 | −5.56 | −0.18 | 0.1 | −0.56 | −0.06 |

As shown in Table 61, Clone C1-3 (hDHFR (A107V)) mutant showed higher fluoresce intensity values than hDHFR (WT) at multiple doses of MTX. Clone C1-4 (hDHFR (F59S)) showed an increase in fluorescence intensity at 33.3 and 11 µM doses of MTX. Clone C1-8 (I17V)), hDHFR (N127Y), and hDHFR (K185E) mutants showed fluorescence intensities that were less than hDHFR (WT).

TABLE 62

Trimethoprim binding analysis

| | | % Normalized Response | | | | |
|---|---|---|---|---|---|---|
| TMP (µM) | hDHFR (WT) | Clone C1-3 (hDHFR (A107V)) | Clone C1-4 (hDHFR (F59S)) | Clone C1-8 (hDHFR (I17V)) | Clone C1-14 (hDHFR (N127Y)) | Clone C1-25 (hDHFR (K185E)) |
| 100 | 100 | 100 | 100 | 100 | 100 | 100 |
| 33.333 | 74.33 | 80.33 | 36.05 | 57.35 | 62.48 | 38.84 |
| 11.111 | 49.7 | 50.43 | 8.01 | 26.08 | 22.34 | 7.58 |
| 3.704 | 5.37 | 27.08 | 1.64 | 7.49 | 5.41 | 0.57 |

TABLE 62-continued

Trimethoprim binding analysis

% Normalized Response

| TMP (μM) | hDHFR (WT) | Clone C1-3 (hDHFR (A107V)) | Clone C1-4 (hDHFR (F59S)) | Clone C1-8 (hDHFR (I17V)) | Clone C1-14 (hDHFR (N127Y)) | Clone C1-25 (hDHFR (K185E)) |
|---|---|---|---|---|---|---|
| 1.235 | −0.22 | 10.6 | −0.29 | 0.44 | 0.7 | −0.27 |
| 0.412 | −6.73 | 4.22 | −0.57 | −0.27 | −0.09 | −0.43 |
| 0.137 | −10.58 | 2.51 | −0.56 | −0.51 | −0.23 | −0.47 |
| 0.046 | −8.3 | 1.56 | −0.57 | −0.28 | −0.2 | −0.44 |

As shown in Table 62, Clone C1-3 (hDHFR (A107V)) mutant showed higher fluorescence intensity values than hDHFR (WT) at multiple doses of TMP. Clone C1-8 (hDHFR (I17V)) an increase in fluorescence intensity at 3.704 μM dose of TMP. Clone C1-8 (hDHFR (I17V)), Clone C1-14 (hDHFR (N127Y)), and Clone C1-25 (hDHFR (K185E)) mutants showed fluorescence intensities that were less than hDHFR (WT).

The binding of hDHFR mutants with MTX was compared to TMP by calculating TMP and MTX ratio. TMP ratio or MTX ratio was defined as the ratio of % Normalized Response of a mutant at a particular dose of the ligand (TMP or MTX) to the % Normalized Response of hDHFR (WT) at the same dose of the same ligand. The ratios are presented in Table 63.

TABLE 63

Methotrexate Vs. Trimethoprim binding analysis

| Ligand (μM) | hDHFR (A107V) | | Clone C1-4 (hDHFR (F59S)) | | Clone C1-8 (hDHFR (I17V)) | | Clone C1-14 (hDHFR (N127Y)) | | Clone C1-21 (hDHFR (K185E)) | |
|---|---|---|---|---|---|---|---|---|---|---|
| | MTX ratio | TMP ratio | MTX ratio | TMP ratio | MTX ratio | TMP ratio | MTX ratio | TMP ratio | MTX ratio | TMP ratio |
| 100 | 1.00 | 1.00 | 1.00 | 1.00 | 1.00 | 1.00 | 1.00 | 1.00 | 1.00 | 1.00 |
| 33.333 | 1.54 | 1.08 | 1.78 | 0.48 | 0.67 | 0.77 | 0.60 | 0.84 | 0.97 | 0.52 |
| 11.111 | 1.25 | 1.01 | 1.43 | 0.16 | 0.64 | 0.52 | 0.51 | 0.45 | 0.70 | 0.15 |
| 3.704 | 1.15 | 5.04 | 0.90 | 0.31 | 0.62 | 1.39 | 0.59 | 1.01 | 0.12 | 0.11 |
| 1.235 | 1.07 | 10.38 | 0.68 | 1.32 | 0.34 | 2.00 | 0.05 | 3.18 | 0.05 | 1.23 |
| 0.412 | 0.58 | 0.63 | 0.28 | 0.08 | 0.04 | 0.04 | 0.02 | 0.01 | 0.02 | 0.06 |
| 0.137 | 0.39 | 0.24 | 0.01 | 0.05 | 0.01 | 0.05 | 0.06 | 0.02 | 0.01 | 0.04 |
| 0.046 | 0.92 | 0.19 | 0.03 | 0.07 | 0.02 | 0.03 | 0.09 | 0.02 | 0.01 | 0.05 |

As shown in Table 63, the MTX and TMP ratios obtained at multiple doses of ligand was comparable and greater than 1, suggesting that Clone C1-3 (hDHFR (A107V)) mutant can bind and be stabilized by both ligands at levels comparable to hDHFR (WT). Clone C1-4 (hDHFR (F59S)) and Clone C1-21 (hDHFR (K185E)) mutants can bind to and be stabilized by MTX at levels comparable to hDHFR (WT), but cannot be stabilized by TMP. While Clone C1-8 (hDHFR (I17V)) and Clone C1-14 (hDHFR (N127Y)) mutants can bind to and be stabilized by TMP, but cannot be stabilized by MTX. These data suggest that Clone C1-3 (hDHFR (A107V)) preserves TMP and MTX stabilization, Clone C1-4 (hDHFR (F59S)) selectively disrupts TMP stabilization while Clone C1-14 (hDHFR (N127Y)) and Clone C1-8 (hDHFR (I17V)) affect MTX stabilization. Thus, Clone C1-3(hDHFR (A107V)) maybe a better substrate for combination mutants and in the search for better TMP binders.

Example 15. E. coli DHFR Regulated Expression

E. coli DHFR (amino acid 2-187 of WT) (R12Y, Y100I) (SEQ ID NO. 3103) were fused to GFP (SEQ ID NO. 6414) and cloned into pLVX vectors and transfected into 293T cells. Transfected cells were incubated with varying concentrations of TMP ranging from 0.001 to 10 μM TMP. DMSO was used as control. Fluorescence signal was measured by FACS and median fluorescence signal intensity (MFI) was calculated. The results are shown in Table 64. Relative MFI was calculated relative to untreated control.

TABLE 64

TMP dependent ecDHFR mutant expression

| TMP (μM) | Median Fluorescence Intensity(MFI) | Relative MFI |
|---|---|---|
| 10 | 1241.61 | 72 |
| 1 | 1218.02 | 71 |
| 0.1 | 695.66 | 40 |
| 0.01 | 47.33 | 3 |
| 0.001 | 20.51 | 1 |
| 0 | 17.21 | 1 |

As shown in Table 64, the relative MFI of TMP treated cells increased with an increase in the concentration of TMP. The relative MFI values plateaued around 1 μM TMP.

Example 16. TMP Dose Responsive Expression of IL15-IL15Ra

Figure 26:
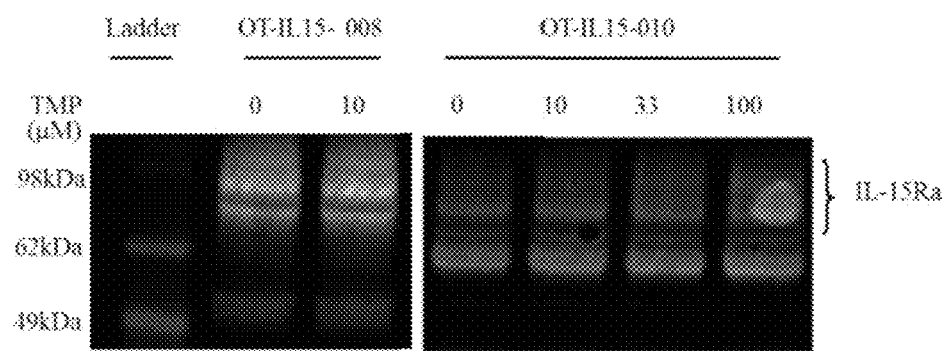
FIG. 26 shows the expression of IL15/IL15Ra fusion protein expression in a western blot using anti IL15 Ra antibody.

IL15-IL15Ra fusion constructs, OT-IL15-008, and OT-IL15-010 were stably expressed in HCT116 cells are treated with increasing doses of TMP ranging from 10 µM, 33 µM, and 100 µM TMP for 24 hours. Cell lysates were obtained and immunoblotted with anti IL15Ra antibody. As shown in FIG. 26, an increase in IL15Ra expression was observed with OT-IL15-010 construct with the addition of TMP. As expected, the constitutive construct, OT-IL15-008 showed strong expression of IL15Ra both in the presence and absence of ligand.

Example 17. TMP Dose Responsive Expression of IL15-IL15Ra

Figure 27:
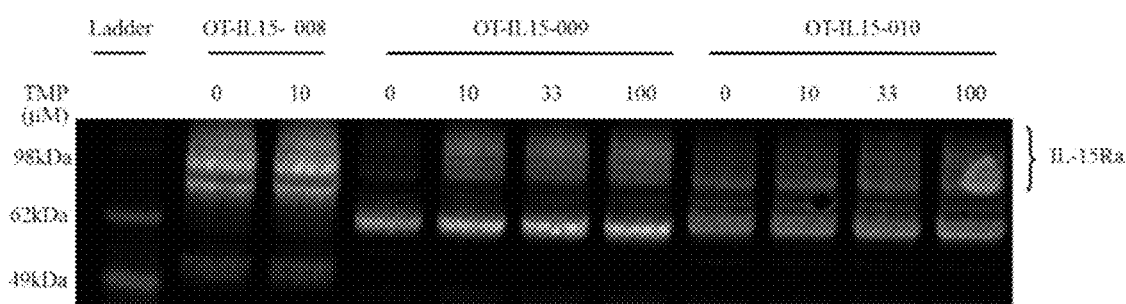
FIG. 27 is a western blot of IL15Ra protein levels in HCT116 cells.
Figure 54A:
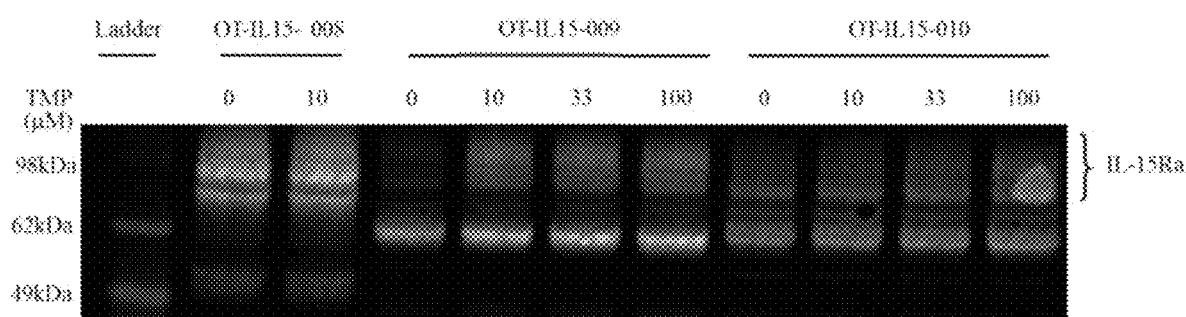
FIG. 54A-FIG. 54C show analyses for IL15 shedding from cells expressing IL15-IL15Ra fusion constructs.

IL15-IL15Ra fusion constructs, OT-IL15-008, OT-IL15-009, and OT-IL15-010 were stably expressed in HCT116 cells and treated with increasing doses of TMP ranging from 10 µM, 33 µM, and 100 µM TMP for 24 hours. Cell lysates were immunoblotted with anti IL15Ra antibody. As shown in FIG. 27 and FIG. 54A, IL15Ra expression of OT-IL15-009 was virtually undetectable in the absence of TMP, and addition of increasing doses of TMP resulted in an increase in IL15Ra levels. Modest increase in IL15Ra expression was observed with OT-IL15-010 construct with the addition of TMP. As expected, the constitutive construct, OT-IL15-008 showed strong expression of IL15Ra both in the presence and absence of ligand.

Example 18. DD Regulated CD19 CAR Expression

A CD19 CAR fusion polypeptide was linked to human DHFR-DD and the constructs were cloned into pLVX-IRES-Puro vector.

hDHFR DDs were positioned at the C terminus of the construct (OT-CD19C-008, OT-CD19C-009, OT-CD19C-010, OT-CD19C-011). In some instances, a furin cleavage site was added between the DD and the CD19 scFv. A constitutively expressed CAR construct, OT-CD19C-001 was used as a positive control.

Figure 28A:
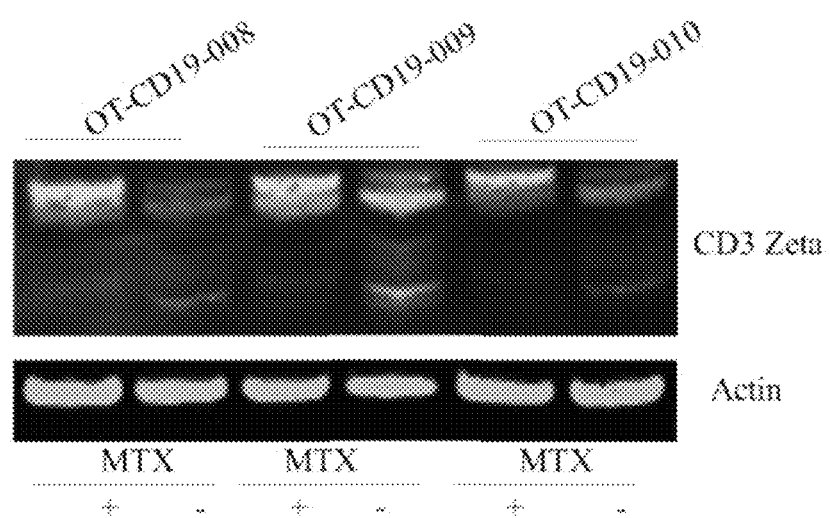
FIG. 28A-FIG. 28B show expression of CD19 chimeric antigen receptors.

To test ligand dependent expression of DD-CD19 CAR constructs, 1 million HEK 293T cells were cultured in growth medium containing DMEM and 10 FBS and transfected with CAR constructs using Lipofectamine 2000. 48 hours after transfection, cells were treated with 1 µM or 10 µM Shield-1, 10 µM Trimethoprim, 1 µM Methotrexate, or vehicle control and incubated for 24 hours. Cells were harvested, lysed and immunoblotted for CD3 Zeta, a component of the CAR, using anti-CD247 (BD Pharmingen, Franklin Lanes, N.J.) and Alexa 555-conjugated-goat-anti mouse antibody (red) (Li-Cor, Lincoln, Nebr.). Lysates were also immunoblotted for Actin with Alexa 488-conjugated secondary antibody (green) to confirm uniform protein loading in all the samples. As shown in FIG. 28A, OT-CD19C-008 and OT-CD19C-010 constructs showed strong increase in CD3 Zeta levels in the presence of Methotrexate and low levels in the absence of ligand, indicating a strong ligand-dependent stabilization of CD19 CAR. CD19C-009 showed modest increase in CD3 Zeta levels in the presence of Methotrexate, indicating a modest ligand-dependent stabilization of CD19 CAR.

Figure 28B:
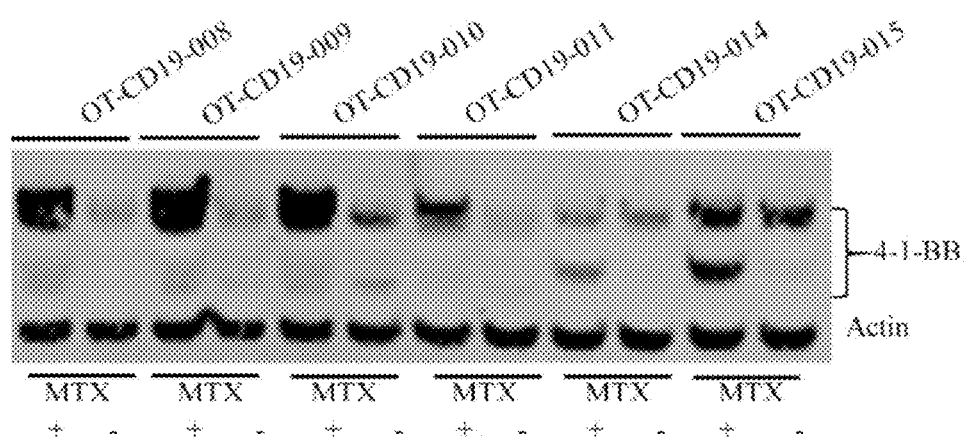

Lysates from cells expressing CD19 CAR constructs were also immunoblotted for 4 1-BB, a component of the CAR. As shown in FIG. 28B, OT-CD19C-008, OT-CD19C-009, OT-CD19C-010 and OT-CD19C-011 showed low levels of 4-1 BB in the absence of ligand and high levels of 4-1 BB in the presence of the ligand, Methotrexate, indicating a strong ligand dependent stabilization of CD19 CAR using these constructs. Constructs OT-CD19N-014 and OT-CD19N-015, which contain a furin cleavage site, showed an additional, smaller 4 1BB protein product upon treatment with MTX. This smaller 4-1BB protein band was only seen with the addition of the ligand and its molecular weight is consistent with the size of the CD19 CAR. These data indicate that the furin cleavage occurs only with ligand treatment.

Surface expression of DD-CD19 CAR constructs in HEK 293T cells was measured using Fluorescence activated cell sorting (FACS) with Protein L-Biotin-Streptavidin-Allophycocyanin which binds to the kappa light chain of the CAR (ThermoFisher Scientific, Waltham, Mass.). Cells were treated with 1 µM Methotrexate, 10 µM Trimethoprim or vehicle control for 24 hours and subject to FACS analysis. The percentage of GFP positive cells obtained with each construct in the presence or absence of ligand is presented in Table 65. In Table 65, N/A indicates not applicable.

TABLE 65

Percentage GFP positive cells

| Construct | Ligand | No Ligand | Ligand |
|---|---|---|---|
| OT-CD19C-001 | N/A | 46.8 | 45.4 |
| OT-CD19C-008 | MTX | 15.8 | 31.3 |
| OT-CD19C-009 | MTX | 16.5 | 34.2 |
| OT-CD19C-010 | MTX | 14.8 | 33 |
| OT-CD19C-011 | MTX | 14.5 | 32.9 |
| OT-CD19C-014 | MTX | 4.68 | 16.2 |
| OT-CD19C-015 | MTX | 3.04 | 18.2 |

An increase in the percentage GFP positive cells was observed with OT-CD19C-008, OT-CD19C-009, OT-CD19C-010, OT-CD19C-011, OT-CD19C-014, and OT-CD19C-015. The highest increase in percentage GFP positive cells was observed with OT-CD19C-014, and OT-CD19C-015 constructs.

The mean fluorescence intensities are presented in Table 66. In Table 66, MFI represents mean fluorescence intensity. The stabilization ratio was calculated as the fold change in GFP intensity in ligand treated samples compared to treatment with DMSO (i.e. in the absence of ligand) with the same construct. The destabilization ratio was calculated as the fold change in GFP intensity in the DD regulated constructs compared to the constitutive construct (OT-CD19C-001) in the absence of the ligand. Destabilization ratios less than 1 and stabilization ratios greater than 1 are desired.

TABLE 66

CD19 CAR surface expression

| Construct | Ligand | MFI No Ligand | MFI Ligand | Destabilization Ratio | Stabilization Ratio |
|---|---|---|---|---|---|
| OT-CD19C-001 | N/A | 453 | 407 |  | 0.90 |
| OT-CD19C-008 | MTX | 89.4 | 148 | 0.20 | 1.66 |
| OT-CD19C-009 | MTX | 93.3 | 200 | 0.21 | 2.14 |
| OT-CD19C-010 | MTX | 85.6 | 160 | 0.19 | 1.87 |

TABLE 66-continued

CD19 CAR surface expression

| Construct | Ligand | MFI No Ligand | MFI Ligand | Destabilization Ratio | Stabilization Ratio |
|---|---|---|---|---|---|
| OT-CD19C-011 | MTX | 83.3 | 172 | 0.18 | 2.06 |
| OT-CD19C-014 | MTX | 78.6 | 124 | 0.17 | 1.58 |
| OT-CD19C-015 | MTX | 73.3 | 143 | 0.16 | 1.95 |

A destabilization ration less than 1 was observed with all constructs indicating that all DD regulated constructs are destabilized in the absence of ligand. A stabilization ratio of greater than 1 was observed with OT-CD19C-008, OT-CD19C-009, OT-CD19C-010, OT-CD19C-011, OT-CD19C-014 and OT-CD19C-015. Notably, these constructs were also destabilized in the absence of ligand and therefore represent suitable CD19-DD constructs.

Example 19. DD Regulated CD19 CAR Expression

A CD19 CAR fusion polypeptide was linked to either FKBP-DD, ecDHFR-DD or human DHFR-DD and the constructs were cloned into pLVX-IRES-Puro vector.

FKBP, ecDHFR and hDHFR DDs were positioned either between the CD19 scFv and the CD8αhinge (OT-CD19C-002, OT-CD19C-003), between the CD8αhinge and the transmembrane domain (OT-CD19C-004, OT-CD19C-005) or at the C terminus of the construct (OT-CD19C-007, OT-CD19C-008, OT-CD19C-009, OT-CD19C-010, OT-CD19C-011). In some instances, a furin cleavage site was added between the DD and the CD19 scFv. A constitutively expressed CAR construct, OT-CD19C-001 was used as a positive control.

Figure 29A:
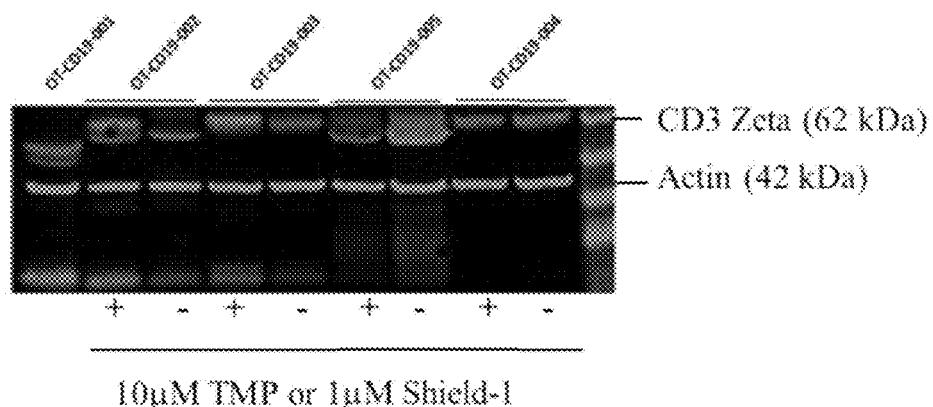
FIG. 29A-FIG. 29D depict results of expression assays for CD19 CAR components.
Figure 29B:
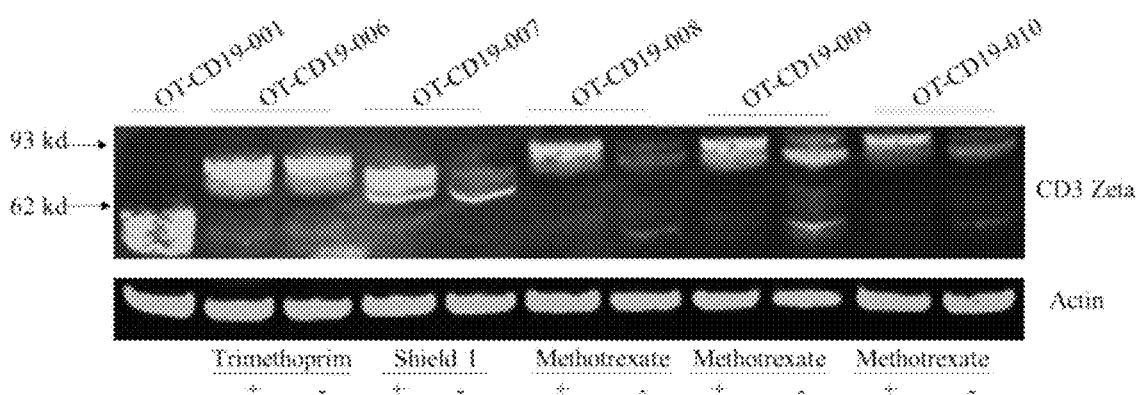

To test ligand dependent expression of DD-CD19 CAR constructs, 1 million HEK 293T cells were cultured in growth medium containing DMEM and 10% FBS and transfected with CAR constructs using Lipofectamine 2000. 48 hours after transfection, cells were treated with 1 µM or 10 µM Shield-1, 10 µM Trimethoprim, 1 µM Methotrexate, or vehicle control and incubated for 24 hours. Cells were harvested, lysed and immunoblotted for CD3 Zeta, a component of the CAR, using anti-CD247 (BD Pharmingen, Franklin Lanes, N.J.) and Alexa 555-conjugated-goat-anti mouse antibody (red) (Li-Cor, Lincoln, Nebr.). Lysates were also immunoblotted for Actin with Alexa 488-conjugated secondary antibody (green) to confirm uniform protein loading in all the samples. Compared to the untreated control, OT-CD19C-002 and OT-CD19C-003 showed increased levels of CD3 Zeta in the presence of ligands Shield-1 and TMP respectively indicating the stabilization of the CD19 CAR (FIG. 29A). As shown in FIG. 29B, OT-CD19C-008 and OT-CD19C-010 constructs showed strong increase in CD3 Zeta levels in the presence of Methotrexate and low levels in the absence of ligand, indicating a strong ligand-dependent stabilization of CD19 CAR. OT-CD19C-007 and OT-CD19C-009 showed modest increase in CD3 Zeta levels in the presence of Shield-1 and Methotrexate respectively, indicating a modest ligand-dependent stabilization of CD19 CAR. As expected, the constructively expressed, OT-CD19C-001 showed strong expression of CD19 CAR in the absence of ligand treatment.

Figure 29C:
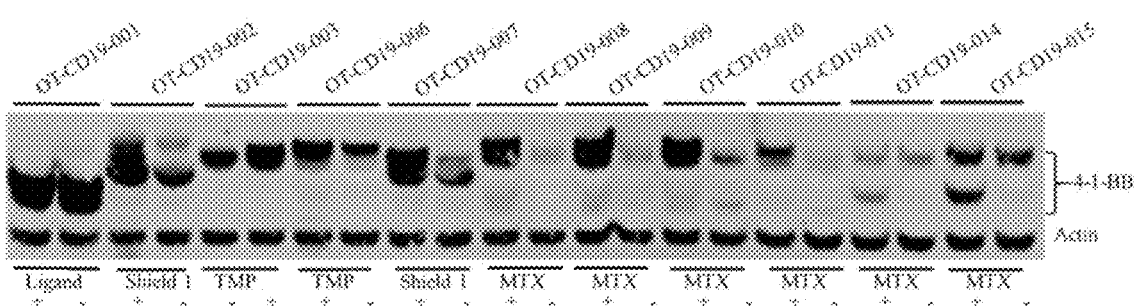

Lysates from cells expressing CD19 CAR constructs were also immunoblotted for 4 1-BB, a component of the CAR. As shown in FIG. 29C, OT-CD19C-008, OT-CD19C-009, OT-CD19C-010 and OT-CD19C-011 showed low levels of 4-1 BB in the absence of ligand and high levels of 4-1 BB in the presence of the ligand, Methotrexate, indicating a strong ligand dependent stabilization of CD19 CAR using these constructs. OT-CD19C-003, OT-CD19C-006 and OT-CD19C-007 showed modest increase in 4-1BB expression levels with treatment of corresponding ligands-TMP and Shield-1, indicating a modest ligand dependent stabilization of CD19 CAR. Constructs OT-CD19N-014 and OT-CD19N-015, which contain a furin cleavage site, showed an additional, smaller 4 1BB sized protein product upon treatment with MTX. This smaller sized 4-1BB protein band was only seen with the addition of the ligand and its molecular weight is consistent with the size of the CD19 CAR in OT-CD19-001. These data indicate that the furin cleavage occurs only with ligand treatment.

Figure 29D:
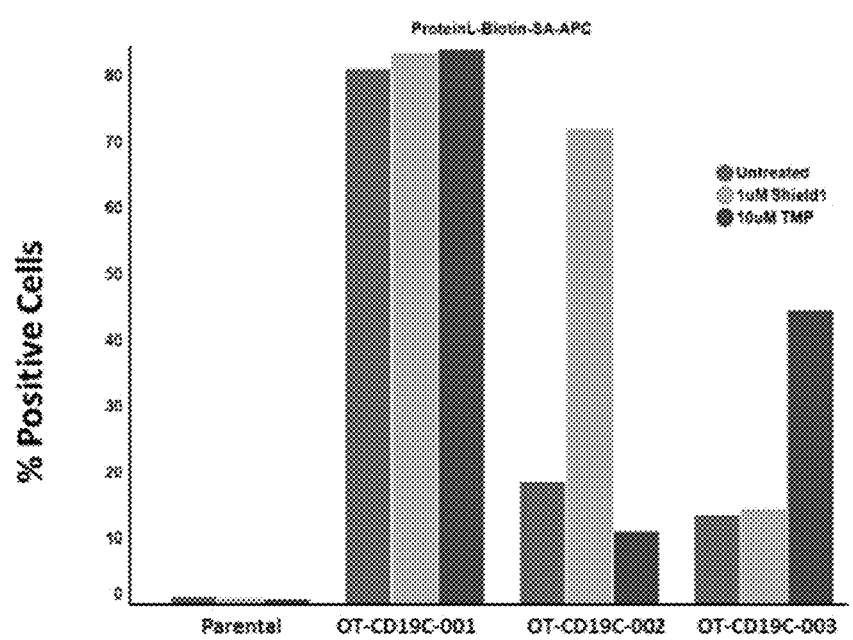

Surface expression of DD-CD19 CAR constructs in HEK 293T cells was measured using Fluorescence activated cell sorting (FACS) with Protein L-Biotin-Strepavidin-Allophycocyanin which binds to the kappa light chain of the CAR (ThermoFisher Scientific, Waltham, Mass.). Cells were treated with 1 µM Shield-1, 1 µM Methotrexate, 10 µM Trimethoprim or vehicle control for 24 hours and subject to FACS analysis. As shown in FIG. 29D, surface expression of OT-CD19C-002 with FKBP-DD was detected only in the presence of Shield-1, while OT-CD19C-003 with ecDHFR-DD showed surface expression only in the presence of Trimethoprim. As expected, constitutively expressed construct OT-C19C-001 showed high expression both in ligand and control vehicle treated cells. Additional constructs were analyzed by FACS with Protein L-Biotin-Strepavidin-Allophycocyanin in a separate experiment. The percentage of GFP positive cells obtained with each construct in the presence or absence of ligand is presented in Table 67. In Table 67, N/A indicates not applicable.

TABLE 67

Percentage GFP positive cells

| Construct | Ligand | Percentage GFP positive cells No Ligand | Percentage GFP positive cells Ligand |
|---|---|---|---|
| OT-CD19C-001 | N/A | 46.8 | 45.4 |
| OT-CD19C-006 | TMP | 46.6 | 43.6 |
| OT-CD19C-007 | Shield-1 | 28.9 | 34 |
| OT-CD19C-008 | MTX | 15.8 | 31.3 |
| OT-CD19C-009 | MTX | 16.5 | 34.2 |
| OT-CD19C-010 | MTX | 14.8 | 33 |
| OT-CD19C-011 | MTX | 14.5 | 32.9 |
| OT-CD19C-012 | TMP | 19.1 | 18.7 |
| OT-CD19C-013 | Shield-1 | 0.91 | 0.4 |
| OT-CD19C-014 | MTX | 4.68 | 16.2 |
| OT-CD19C-015 | MTX | 3.04 | 18.2 |

An increase in the percentage GFP positive cells was observed with OT-CD19C-007, OT-CD19C-008, OT-CD19C-009, OT-CD19C-010, OT-CD19C-011, OT-CD19C-014, and OT-CD19C-015. The highest increase in the percentage of GFP positive cells was observed with OT-CD19C-014, and OT-CD19C-015 constructs.

The mean fluorescence intensities are presented in Table 68. In Table 68, MFI represents mean fluorescence intensity. The stabilization ratio was calculated as the fold change in GFP intensity in ligand treated samples compared to treatment with DMSO (i.e. in the absence of ligand) with the same construct. The destabilization ratio was calculated as the fold change in GFP intensity in the DD regulated constructs compared to the constitutive construct (OT- CD19C-001) in the absence of the ligand. Destabilization ratios less than 1 and stabilization ratios greater than 1 are desired.

TABLE 68

CD19 CAR surface expression

| Construct | Ligand | MFI | | Destabilization Ratio | Stabilization Ratio |
|---|---|---|---|---|---|
| | | No Ligand | Ligand | | |
| OT-CD19C-001 | N/A | 453 | 407 | | 0.90 |
| OT-CD19C-006 | TMP | 425 | 325 | 0.94 | 0.76 |
| OT-CD19C-007 | Shield-1 | 132 | 123 | 0.29 | 0.93 |
| OT-CD19C-008 | MTX | 89.4 | 148 | 0.20 | 1.66 |
| OT-CD19C-009 | MTX | 93.3 | 200 | 0.21 | 2.14 |
| OT-CD19C-010 | MTX | 85.6 | 160 | 0.19 | 1.87 |
| OT-CD19C-011 | MTX | 83.3 | 172 | 0.18 | 2.06 |
| OT-CD19C-012 | TMP | 112 | 105 | 0.25 | 0.94 |
| OT-CD19C-013 | Shield-1 | 61 | 49.5 | 0.13 | 0.81 |
| OT-CD19C-014 | MTX | 78.6 | 124 | 0.17 | 1.58 |
| OT-CD19C-015 | MTX | 73.3 | 143 | 0.16 | 1.95 |

A destabilization ration less than 1 was observed with all constructs indicating that all DD regulated constructs are destabilized in the absence of ligand. A stabilization ratio of greater than 1 was observed with OT-CD19C-008, OT-CD19C-009, OT-CD19C-010, OT-CD19C-011, OT-CD19C-014 and OT-CD19C-015. Notably, these constructs were also destabilized in the absence of ligand and therefore represent suitable CD19-DD constructs.

Example 20. Dose Dependent Stabilization of DDs Derived by Random Mutagenesis

Figure 30A:
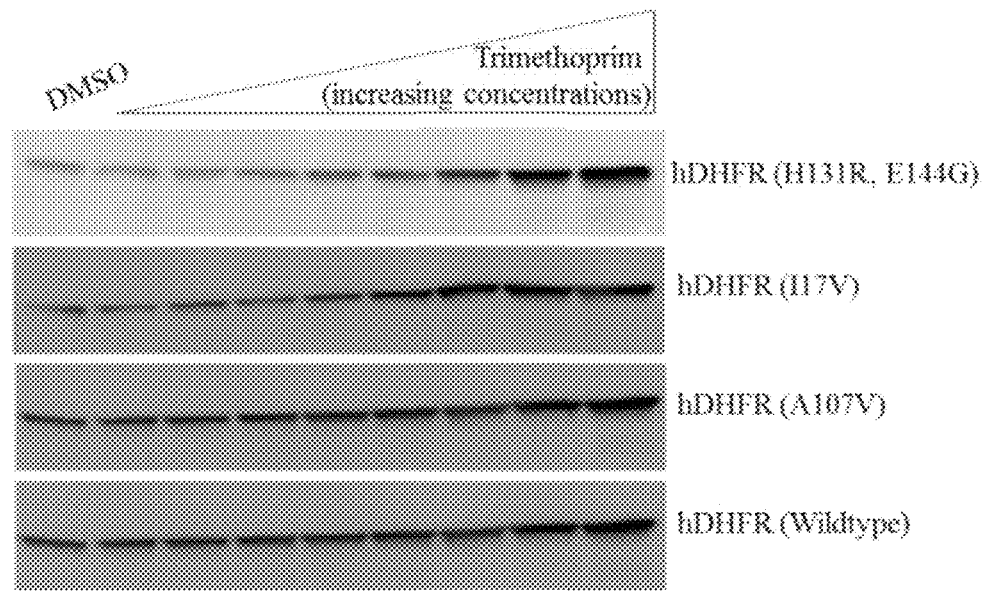
FIG. 30A-FIG. 30B depict expression of DHFR mutants with Trimethoprim or Methotrexate in HEK293 cells.

The ligand dose responsive of human DHFR mutants generated by random mutagenesis was analyzed. DHFR mutants were fused to GFP, transfected into HEK293 cells and treated with increasing doses of Trimethoprim and Methotrexate for 48 hours. Cell lysates were harvested and immunoblotted using Anti-AcGFP antibody (Clonetech, Mountain View, Calif.) by western blotting. As shown in FIG. 30A, hDHFR (H131R, E144G) showed low basal expression with DMSO treatment and TMP dose dependent stabilization. A modest TMP dependent stabilization was observed with the mutant Clone C1-8 (hDHFR (I17V)) and hDHFR (Wildtype), although the basal expression in the absence of ligand was still detectable.

Figure 30B:
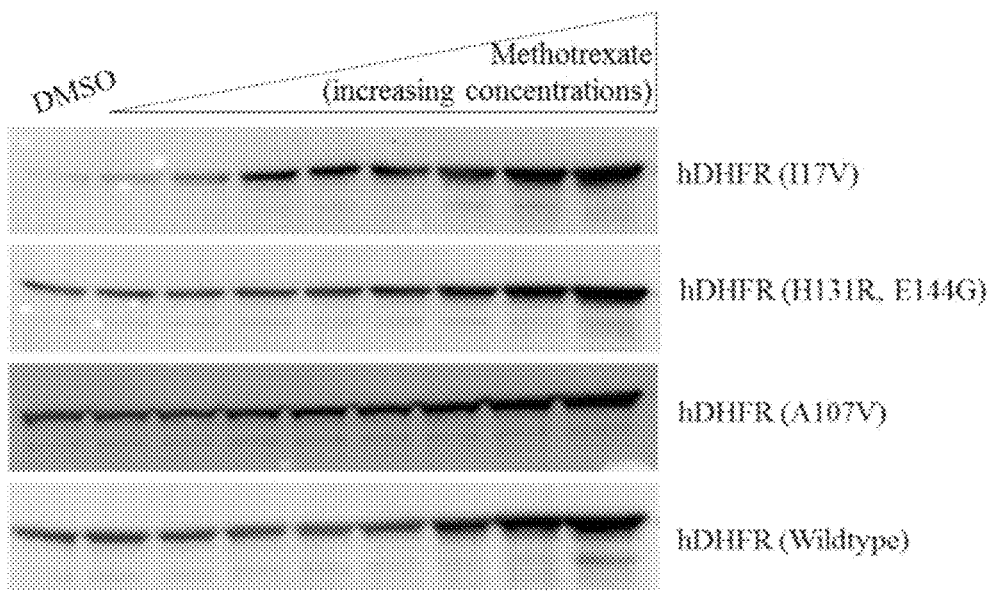

FIG. 30B represents ligand dependent stabilization observed with MTX. In this instance both Clone C1-8 (hDHFR (I17V)) and hDHFR (H131R, E144G) showed low basal expression in the absence of MTX and strong MTX dependent stabilization.

Dose dependent stabilization was also measured using FACS to measure mean fluorescence intensity (MFI). The MFI values and the stabilization ratios calculated based on the MFIs are presented in Table 69 and 70 respectively.

TABLE 69

Dose response of DHFR mutants

| TMP dose (log M) | Clone C1-3 (A107V) | Clone C1-8 (I17V) | Clone C1-14 (N127Y) | Clone C2-20 (N186D) | Clone C2-25 (E162G, I17G) | Clone C3-3 (M140I) | Clone C3-9 (H131R, E144G) |
|---|---|---|---|---|---|---|---|
| DMSO | 19720 | 2875 | 3581 | 19902 | 1894 | 2957 | 2464 |
| −6.86 | 21870 | 3103 | 3535 | 30758 | 1891 | 2699 | 2530 |
| −6.39 | 28772 | 3648 | 4272 | 30389 | 1964 | 3007 | 2545 |
| −5.91 | 40094 | 5251 | 5987 | 46567 | 2225 | 4213 | 3315 |
| −5.43 | 66181 | 11893 | 13591 | 74231 | 3467 | 6131 | 4738 |
| −4.95 | 82770 | 32011 | 31359 | 120106 | 5053 | 15187 | 8464 |
| −4.48 | 94393 | 48198 | 51745 | 117316 | 22849 | 34447 | 21677 |
| −4.00 | 107654 | 74488 | 74118 | 125048 | 37159 | 64607 | 50560 |

TABLE 70B

Stabilization ratios of DHFR mutants

| TMP dose (log M) | Clone C1-3 (A107V) | Clone C1-8 (I17V) | Clone C1-14 (N127Y) | Clone C2-20 (N186D) | Clone C2-25 (E162G, I17G) | Clone C3-3 (M140I) | Clone C3-9 (H131R, E144G) |
|---|---|---|---|---|---|---|---|
| −6.86 | 1.11 | 1.08 | 0.99 | 1.55 | 1.00 | 0.91 | 1.03 |
| −6.39 | 1.46 | 1.27 | 1.19 | 1.53 | 1.04 | 1.02 | 1.03 |
| −5.91 | 2.03 | 1.83 | 1.67 | 2.34 | 1.17 | 1.42 | 1.35 |
| −5.43 | 3.36 | 4.14 | 3.80 | 3.73 | 1.83 | 2.07 | 1.92 |
| −4.95 | 4.20 | 11.13 | 8.76 | 6.03 | 2.67 | 5.14 | 3.44 |
| −4.48 | 4.79 | 16.76 | 14.45 | 5.89 | 12.06 | 11.65 | 8.80 |
| −4.00 | 5.46 | 25.91 | 20.70 | 6.28 | 19.62 | 21.85 | 20.52 |

As shown in Table 69 and Table 70, constructs, C1-8, clone 1-14, clone 2-25, clone 3-3 and C3-9 showed robust ligand dependent stabilization over a range of TMP doses demonstrating the tunability of these constructs. Constructs C1-3 and C2-20, showed modest ligand dependent stabilization even at the highest doses of TMP. Further even in the absence of ligand C1-3 and C2-20 showed high basal expression compared to the other constructs tested, indicating that C1-8, clone 1-14, clone 2-25, clone 3-3 and C3-9 may be suitable DDs for further analysis. DHFR mutants were analyzed at a fixed dose over 0-48 hours and analyzed by FACS. The mean fluorescence intensity and destabilizing mutation co-efficient s are shown in Tables 71 and 72 respectively.

(N127Y)), C1-18 (hDHFR (V9A, S93R, P150L)), C1-21 hDHFR (K185E)), C1-24 (hDHFR (V110A, V136M, K177R)), C1-4 (hDHFR (F59S)), C1-8 (hDHFR (I17V)), C2-15 (hDHFR (K19E, F89L, E181G)), C2-21 (hDHFR (A10V, H88Y)), C2-23 (hDHFR (L23S, V121A, Y157C)), C2-25 (hDHFR (E162G, I176F)), C3-1 (hDHFR (Y178H, E181G)), C3-10 (hDHFR (Y183H, K185E)), C3-22 (hDHFR (T57A, I72A)), C3-3 (hDHFR (M140I)), C3-9 (hDHFR (H131R, E144G)), C4-3 (hDHFR (G21E, I72V, I176T)). Among these, constructs C1-14 (hDHFR (N127Y)), C1-21 hDHFR (K185E)), C1-4 (hDHFR (F59S)), C2-15 (hDHFR (K19E, F89L, E181G)), C2-21 (hDHFR (A10V, H88Y)), C2-25 (hDHFR (E162G, I176F)), C3-1 (hDHFR (Y178H, E181G)), C3-10 (hDHFR (Y183H,

TABLE 71

Time course of DHFR mutants

| Time (hours) | Clone C1-3 (A107V) | Clone C1-8 (I17V) | Clone C1-14 (N127Y) | Clone C2-20 (N186D) | Clone C2-25 (E162G, I17G) | Clone C3-3 (M140I) | Clone C3-9 (H131R, E144G) |
|---|---|---|---|---|---|---|---|
| 0 | 31994 | 4698 | 6960 | 38817 | 2529 | 4128 | 3163 |
| 4 | 32734 | 6429 | 9784 | 47867 | 4475 | 6173 | 5508 |
| 8 | 35802 | 9369 | 13441 | 49577 | 8434 | 9731 | 9893 |
| 12 | 42626 | 17719 | 22919 | 62290 | 11759 | 15300 | 12964 |
| 16 | 56181 | 29864 | 35122 | 80947 | 15363 | 23539 | 20010 |
| 20 | 67701 | 40277 | 48327 | 91020 | 22069 | 30451 | 26826 |
| 24 | 80303 | 55735 | 68399 | 126779 | 31618 | 49216 | 35591 |
| 48 | 148033 | 109505 | 141768 | 217925 | 45644 | 88419 | 60171 |

TABLE 72

Stabilization ratios over time of DHFR mutants

| Time (hours) | Clone C1-3 (A107V) | Clone C1-8 (I17V) | Clone C1-14 (N127Y) | Clone C2-20 (N186D) | Clone C2-25 (E162G, I17G) | Clone C3-3 (M140I) | Clone C3-9 (H131R, E144G) |
|---|---|---|---|---|---|---|---|
| 4 | 1.02 | 1.37 | 1.41 | 1.23 | 1.77 | 1.50 | 1.74 |
| 8 | 1.12 | 1.99 | 1.93 | 1.28 | 3.33 | 2.36 | 3.13 |
| 12 | 1.33 | 3.77 | 3.29 | 1.60 | 4.65 | 3.71 | 4.10 |
| 16 | 1.76 | 6.36 | 5.05 | 2.09 | 6.07 | 5.70 | 6.33 |
| 20 | 2.12 | 8.57 | 6.94 | 2.34 | 8.73 | 7.38 | 8.48 |
| 24 | 2.51 | 11.86 | 9.83 | 3.27 | 12.50 | 11.92 | 11.25 |
| 48 | 4.63 | 23.31 | 20.37 | 5.61 | 18.05 | 21.42 | 19.02 |

Similar to the dose response analysis, it was found that only clones C1-3 and C2-20 showed modest stabilization ratios over time. In contrast, all other constructs tested showed robust stabilization over time upon addition of ligand.

Example 21. Structural Mapping of Destabilizing Mutations

Mutations identified by random mutagenesis and analyzed by FACS were mapped onto the H2W3A structure of hDHFR from the protein data bank. Both inhibitors of DHFR, namely Trimethoprim and Methotrexate as well as co-factor, NADP were modelled into the structure of DHFR. The positions of the destabilizing mutations, relative to the ligand and co-factor were visualized. Only constructs that showed destabilization in the absence of ligand and ligand dependent stabilization were chosen for the analysis were chosen. The constructs tested include C1-14 (hDHFR K185E)), C3-22 (hDHFR (T57A, I72A)), C3-3 (hDHFR (M140I)), and C4-3 (hDHFR (G21E, I72V, I176T)) were found to be located outside both the ligand and co-factor binding pocket and are present on surface residues. In contrast constructs C3-9 (hDHFR (H131R, E144G)), C1-24 (hDHFR (V110A, V136M, K177R)), C2-23 (hDHFR (L23S, V121A, Y157C)), C1-8 (hDHFR (I17V)), and C1-18 (hDHFR (V9A, S93R, P150L)) were found to be either in or near the ligand and/or co-factor binding pocket, away from the surface. These results suggest that most of the destabilizing mutations are located away from the ligand and co-factor binding pocket and are in surface residues.

Example 22. Combination Mutation Analysis

Mutations identified by random mutagenesis were combined with mutations identified by site directed mutagenesis. Constructs OT-DHFRC-029 (I17V, Y122I), OT-hDHFRC-030 (Y122I, M140I), OT-hDHFRC-031 (N127Y, Y122I)

and OT-hDHFRC-032 (Y122I, H131R, E144G) were transduced into HCT116 cells and treated with Trimethoprim for 48 hours. Median fluorescence intensity (MFI) was measured by FACS and the results are shown in Table 73.

TABLE 73

Dose response of combination mutants

| TMP dose (log) | OT-DHFRC-029 MFI | Stabilization ratio | OT-hDHFRC-030 MFI | Stabilization ratio | OT-hDHFRC-031 MFI | Stabilization ratio | OT-hDHFRC-032 MFI | Stabilization ratio |
|---|---|---|---|---|---|---|---|---|
| DMSO | 3041 | — | 2539 | — | 2565 | — | 2627 | — |
| −6.86 | 3439 | 1.13 | 2643 | 1.04 | 2922 | 1.14 | 2704 | 1.03 |
| −6.39 | 4355 | 1.43 | 2618 | 1.03 | 3345 | 1.30 | 2694 | 1.03 |
| −5.91 | 6966 | 2.29 | 2766 | 1.09 | 5576 | 2.17 | 2826 | 1.08 |
| −5.43 | 23454 | 7.71 | 3494 | 1.38 | 15743 | 6.14 | 3246 | 1.24 |
| −4.95 | 66170 | 21.76 | 6641 | 2.62 | 53282 | 20.77 | 5092 | 1.94 |
| −4.48 | 115339 | 37.93 | 20890 | 8.23 | 98805 | 38.52 | 12247 | 4.66 |
| −4 | 158659 | 52.17 | 66732 | 26.28 | 145144 | 56.59 | 49891 | 18.99 |

As shown in Table 73, all constructs showed very low basal expression compared to the expression obtained in the presence of ligand. In the presence of TMP, constructs OT-DHFRC-029 and 031 showed a good dynamic range of GFP expression. OT-DHFRC-030 and OT-DHFRC-032 showed GFP expression only at the highest doses.

Example 23. Mutagenesis of DD Hotspots

The analysis of mutants generated by site directed and random mutagenesis identified amino acid hotspots whose mutation confers destabilization and ligand dependent stabilization properties to DHFR. To improve the DD characteristics of these constructs, the amino acid at the hotspot position is mutated to any of the known amino acids, including, but not limited to lysine, aspartic acid, glutamic acid, glutamine, asparagine, histidine, serine, threonine, tyrosine, cysteine, methionine, tryptophan, alanine, isoleucine, leucine, phenylalanine, valine, proline, and glycine. A library of hotspot mutations is generated by site directed mutagenesis and each of the mutants in the library is fused to a reporter protein e.g. AcGFP via a linker. The properties of the DDs are analyzed in the presence and absence of ligands via western blot and FACS as previously described. Ligands evaluated include, but are not limited TMP and MTX.

Example 24. Destabilizing Domains with Improved Ligand Binding

To improve ligand binding one or more of the residues of dihydrofolate reductase that interact with ligands such as TMP and MTX are mutated. Based on the structural analysis of DHFR bound trimethoprim, key DHFR residues required for binding to TMP were identified. These include aspartic acid at position 22 which contributes to loop charge, glutamic acid at position 31, phenylalanine at position 32 which is in the ligand binding pocket, arginine at position 33 which plays a role in helix orientation, glutamine at position 36 which plays a role in helix orientation, asparagine at position 65 which lines the binding pocket and valine at position 116. These residues were mutated as follows, D22S, E31D, F32M, R33S, Q36S, N65S, and V116I and constructs OT-hDHFRC-027 and OT-hDHFRC-028 are generated. Constructs are introduced by transfection or transduction into cell lines such as HEK293T cells and HCT116 cells. Ligand dependent stabilization of expression is measured by comparing the expression of the constructs in the presence of varying doses of the ligand to the expression of the construct in the absence of the ligand. The kinetics of the ligand dose responsive behavior of OT-DHFRC-027 and OT-DHFRC-028 are compared to other DD constructs described. OT-DHFRC-027 and OT-DHFRC-028 are expected to demonstrate better binding to TMP at lower concentrations of TMP, when compared to wildtype and other DHFR-DD constructs.

Example 25. Optimizing Biocircuit Behavior

The biocircuits of the invention comprise multiple modules which can be optimized. Libraries of each of the components is generated to allow for the rapid generation of new constructs with desired behaviors. Ligand pharmacokinetics is a powerful tool for payload specific tuning in vivo, which can be used to shift the ligand response curve of the effector module to the left or right depending on the modulating factors. Several modulating factors are tested, including, but not limited to the ligand dose, concentrations, magnitude, duration, and route of administration. Destabilizing domains can also be modified to improve biocircuit behavior. The destabilizing domain is the core determinant of the dynamic range of the biocircuit. Depending on the DD selected, the ligand response curve of the effector module can be shifted up or down. The nature, position of the DD within the effector module as well as the number of DDs within an effector module are modified. DD selection is also altered depending on its degradation kinetics desired. Promoters that transcriptionally control the expression of the SREs are optimized. Choice of promoter impacts the basal-off state and affects the dynamic range of stabilization. Further, promoter choice contributes to the extent of stabilized payload produced. Other optimizable elements of the biocircuits include vector, translational elements, leader sequence, placement of the components within the SRE, codon selection, protease sites, linkers, and mRNA stability.

Example 26. DD Regulated Caspase 9

A caspase 9 polypeptide was linked to the N or C-terminus of FKBP, ecDHFR and hDHFR DDs and cloned into pLVX.IRES. Puro vectors. To test ligand dependent Caspase 9 production, 1 million HEK-293T cells are plated in a 6-well plate in growth media containing DMEM and 10 FBS and incubated overnight at 37° C., 5% CO2. Cells are transiently transfected with 100 ng of DD-Caspase 9 constructs using Lipofectamine 2000 and incubated for 48 hrs.

Following the incubation, growth media is exchanged for media containing ligands (Trimethoprim, Methotrexate, or Shield-1, depending on the construct used). Following 24-hour incubation with ligand, cells are lysed and immunoblotted for caspase 9. Increase in Caspase 9 levels with increase in ligand concentrations is indicative of DD mediated regulation of Caspase 9.

Example 27. Ligand Dependent Stabilization of Luciferase Tagged DHFR DD

Luciferase tagged DHFR DD constructs allows the in vivo tracking of DHFR DDs and evaluation of in vivo kinetics of destabilization and ligand dependent stabilization. OT-DHFR-023 to OT-DHFR-028 were generated by appending DHFR DDs described herein to luciferase. The constructs were stably transduced into HCT116 cells and seeded into 96-well plates at 2000/well. The cells were incubated with 50 µM TMP or without TMP i.e. vehicle control, for 48 hrs. The cells were lysed, and the luciferase activity was measured. The results are shown in Table 74. The stabilization ratio which is defined as the stabilization ratio was calculated as the fold change in GFP intensity in ligand treated samples compared to treatment with vehicle control (i.e. in the absence of ligand) with the same construct. The parental untransduced HCT116 cells were included in the experiment as a negative control.

TABLE 74

Luciferase activity

|  | Vehicle | TMP | Stabilization Ratio |
| --- | --- | --- | --- |
| Parental | 1474.7 | 1797.73 | 1.22 |
| OT-DHFR-023 | 584581.1 | 841816.8 | 1.44 |
| OT-DHFR-024 | 246206.7 | 583806.7 | 2.37 |
| OT-DHFR-025 | 308483.2 | 652375.1 | 2.11 |
| OT-DHFR-026 | 350832 | 792842.8 | 2.26 |

As shown in Table 74, OT-DHFR-024, OT-DHFR-025 and OT-DHFR-026 showed stabilization ratios greater than 2, which is greater than the ratio observed with the parental cells. In contrast, OT-DHFR-023 show a stabilization ratio comparable to the parent cells, indicating that the luciferase expression observed with this construct is not significantly higher than background luciferase expression detected with the assay.

Example 28: Enhancing DD-Ligand Interaction

To improve the binding of DHFR DDs to TMP, a mutant library is generated using DHFR (Y122I) as the template. The DDs are tagged to reporter proteins such as GFP. Mutant libraries are generated by error-prone PCR and/or commercially available kits such as GeneMorph II (Agilent, Santa Clara, Calif.). The libraries are packaged in lentivirus vectors such as pLVX-IRES-puro and are screened for GFP expression in the presence or absence of TMP. Clones from the library that show higher GFP expression than the template, in the presence of TMP, as well as little to no GFP in the absence of ligand.

Example 29. DD Regulated Recombinant IL12 Expression

FKBP (DD)-IL12 and DHFR (DD)-IL12 constructs were packaged into pLVX IRES-Puro lentiviral vectors with CMV, EF1a, or PGK promoters or without a promoter. The IL12 consists of two subunits, p40 and p35 which are separated by a linker. A p40 signal sequence was inserted next to the DD or IL12. In several constructs, a furin protease cleavage site or a modified furin site was included.

HEK293T cells were transiently transfected with 200 ng or 1 µg of FKBP-IL12 plasmids (OT-IL12-001 to OT-IL12-005), and subsequently treated with 10 µM Shield-1 or vehicle control for 6 hours. Culture media was collected from transfected cells and diluted 1:50 to measure IL12 levels using p40 ELISA. The stabilization ratio was defined as fold change in IL12 expression with ligand treatment compared to treatment with DMSO (i.e. in the absence of ligand) with the same construct. Stabilization ratio greater than 1 is desired. The average IL12 ELISA readings and stabilization ratio are presented in Table 75.

TABLE 75

Ligand dependent IL12 induction

| Construct ID | Vehicle | 10 µM Shield-1 | Stabilization ratio |
| --- | --- | --- | --- |
| OT-IL12-001 | 1289.61 | 1748.95 | 1.36 |
| OT-IL12-002 | 18.01 | 50.73 | 2.82 |
| OT-IL12-003 | 1762.55 | 2138.25 | 1.21 |
| OT-IL12-004 | 385.95 | 1567.62 | 4.06 |
| OT-IL12-005 | 1188.42 | 2670.80 | 2.25 |
| HEK293T | −12.921 | −22.015 |  |

OT-IL12-002 and OT-IL12-004 showed low level of IL12 expression in the absence of ligand when compared to IL12 levels in HEK 293T parental cells. Treatment with Shield-1 resulted in an increase in IL12 levels in OT-IL12-002, OT-IL12-004, and OT-IL12-005 constructs and a stabilization ratio between 2 and 4. These data show that OT-IL12-002 and OT-IL12-004 are destabilized in the absence of these constructs are stabilized by Shield-1.

IL12 expression was measured in cells following stable transduction. 500,000 cells stably transduced with OT-IL12-004 were plated in a 12 well plate and incubated overnight in growth media consisting of Dulbecco's Modified Eagle medium (DMEM) and 10% fetal bovine serum (FBS). The next day, cells were treated with 11 µM Shield-1 or vehicle control for 6 or 24 hours. Following treatment with Shield-1, growth media was collected from the cells and diluted 10, 40, 160 or 640 fold and IL12 levels were quantified using IL12-p40 ELISA. The stabilization ratio was defined as fold change in IL2 expression with ligand treatment compared to treatment with DMSO (i.e. in the absence of ligand) with the same construct. Stabilization ratio greater than 1 is desired. The average IL12 ELISA readings and stabilization ratio at 6 hours are presented in Table 76.

TABLE 76

Ligand dependent IL12 induction (6 hours)

| | 6 hours | | |
| --- | --- | --- | --- |
| Media dilution (fold) | Vehicle | Shield-1 | Stabilization ratio |
| 10 | 0.17 | 0.58 | 3.35 |
| 40 | 0.10 | 0.26 | 2.62 |
| 160 | 0.08 | 0.12 | 1.41 |
| 640 | 0.09 | 0.08 | 0.93 |

IL12 stabilization ratio greater than 1 was observed at 10, 40 and 160-fold dilutions of media, indicating that IL12 is stabilized by Shield-1 treatment at these dilutions at 6 hours.

The average IL12 ELISA readings and stabilization ratio at 24 hours are presented in Table 77.

TABLE 77

Ligand dependent IL12 induction (24 hours)

| Media dilution (fold) | 24 hours | | |
|---|---|---|---|
| | Vehicle | Shield-1 | Stabilization ratio |
| 10 | 0.28 | 1.33 | 4.69 |
| 40 | 0.12 | 0.79 | 6.39 |
| 160 | 0.09 | 0.30 | 3.44 |
| 640 | 0.08 | 0.12 | 1.46 |

IL12 stabilization ratio was greater than 1 at all media dilutions tested and the highest stabilization ratio was observed at 40-fold dilution of media at 24 hours, suggesting ligand dependent stabilization.

To evaluate Shield-1 dependent FKBP-IL12 induction over time, 2 million cells were plated in growth medium and incubated overnight in the presence of 1 μM Shield-1 or vehicle control. Cells were then incubated for with the ligand for 2, 4, 6, 8, 24, 48, or 72 hours and growth media was collected for the cells at all time points. Growth media was diluted 400-fold and IL12 levels were measured using IL12 p40 ELISA. The stabilization ratio was defined as fold change in IL12 expression with ligand treatment compared to treatment with DMSO (i.e. in the absence of ligand) with the same construct. Stabilization ratio greater than 1 is desired. Average IL12 ELISA readings and stabilization ratio are presented in Table 78.

TABLE 78

IL12 induction over time

| Time (hrs) | Vehicle | Shield-1 | Stabilization ratio |
|---|---|---|---|
| 2 | 0.13 | 0.18 | 1.41 |
| 4 | 0.14 | 0.26 | 1.89 |
| 6 | 0.13 | 0.29 | 2.30 |
| 8 | 0.14 | 0.28 | 1.99 |
| 24 | 0.18 | 0.99 | 5.47 |
| 48 | 0.23 | 1.79 | 7.71 |
| 72 | 0.26 | 1.63 | 6.28 |

Stabilization ratio increased over time and peaked at 48 hours, suggesting that IL12 is stabilized by Shield-1 with increasing duration of ligand treatment.

To evaluate the dependence of FKBP-IL12 production on Shield-1 dose levels, OT-IL12-004 transduced HEK293T cells were plated at different densities (40,000 cells, 20,000 cells, 10,000 cells or 5,000 cells per well) onto a 96-well plate. Following overnight incubation, cells were treated with growth medium containing 0 to 10 μM Shield-1 for 24 hours. Media was then collected, diluted 400-fold and FKBP-IL12 levels were measured using IL12-p40 ELISA. Average IL12 ELISA readings are presented in Table 79.

TABLE 79

Dose and cell number dependent IL12 induction

| Shield-1 (μM) | 40000 cells/well | 20000 cells/well | 10000 cells/well | 5000 cells/well |
|---|---|---|---|---|
| 10 | 623.77 | 656.70 | 214.11 | 193.62 |
| 3.333333 | 670.64 | 618.10 | 273.74 | 207.55 |
| 1.111111 | 677.27 | 872.24 | 322.56 | 203.71 |
| 0.37037 | 368.17 | 582.71 | 250.49 | 172.50 |
| 0.123457 | 197.29 | 343.34 | 156.98 | 95.92 |
| 0.041152 | 171.50 | 205.68 | 63.79 | 48.89 |
| 0.013717 | 117.25 | 103.56 | 13.30 | −2.35 |
| 0.004572 | 66.34 | 60.58 | 2.11 | −8.53 |
| 0.001524 | 100.43 | 39.55 | −13.58 | −21.76 |
| 0 | 83.49 | 7.92 | −21.76 | −26.97 |

A dose dependent IL12 induction was observed at all cell numbers tested. IL12 induction increased with Shield-1 up to a dose of 1 μM; following which IL12 induction plateaued. Notably, greater IL12 induction was observed at 2000 and 4000 cells/well.

Example 30. DD Regulated Recombinant IL12 Mediated Functions in HEK293T Cells

Figure 31A:
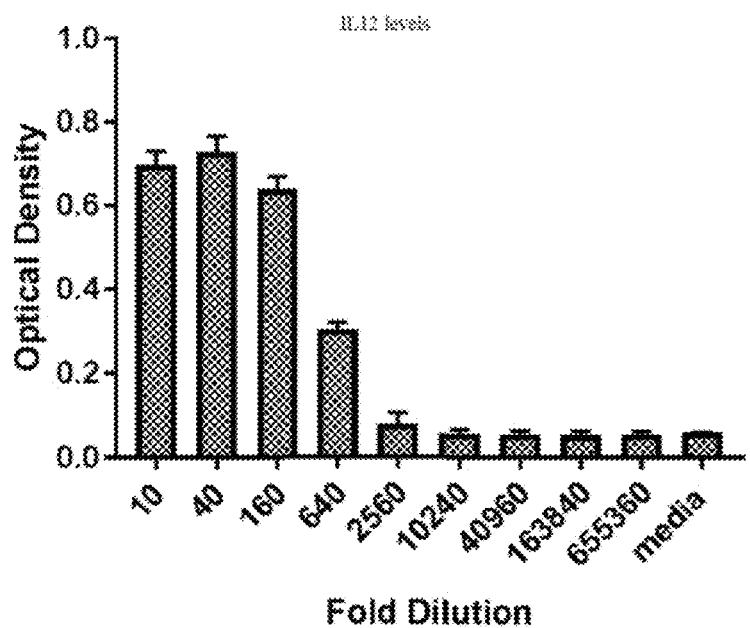
FIG. 31A-FIG. 31D depict results from assays measuring IL12 levels.

HEK-Blue sensor cells (InvivoGen, San Diego, Calif.) were utilized to evaluate whether DD regulated IL12 is capable of regulating signaling downstream of IL12. In these cells, the IL12 receptor, STAT4 and downstream transcriptional elements are linked to a reporter gene such that IL12 signaling can be monitored. One million HEK 293T were transfected with 200 ng of OT-IL12-003 plasmid using Lipofectamine 2000 (Thermo Fisher Scientific, Waltham, Mass.). 48 hours after transfection, cells were treated with growth media containing 10 μM Shield-1, incubated for another 24 hours, following which, media was collected. 50,000 HEK 293 Blue sensor cells were plated onto 96 well plates and incubated overnight with media (at different dilutions) from Shield-1 treated OT-IL12-003 expressing HEK293T cells. After overnight incubation, 20 μl media was removed from each well and incubated with 180 μl Quanti-Blue reagent (InvivoGen, San Diego, Calif.) for 30 minutes at 37° C. Absorption was measured at 620 nm using a spectrophotometer. To generate a standard curve, 180 μl Quanti-Blue reagent was mixed with 20 μl of recombinant IL12 at following concentrations 500, 250, 125, 62.5, 31.25, 15.62, 7.8 and 3.9 pg/ml. Functional IL12 concentrations were determined by comparing the optical density of each sample with IL12 standard curve. Measurable levels of functional IL12 were reached with 640-fold dilutions of IL12 containing growth media and further plateaued at higher concentrations of the media (FIG. 31A).

Figure 31B:
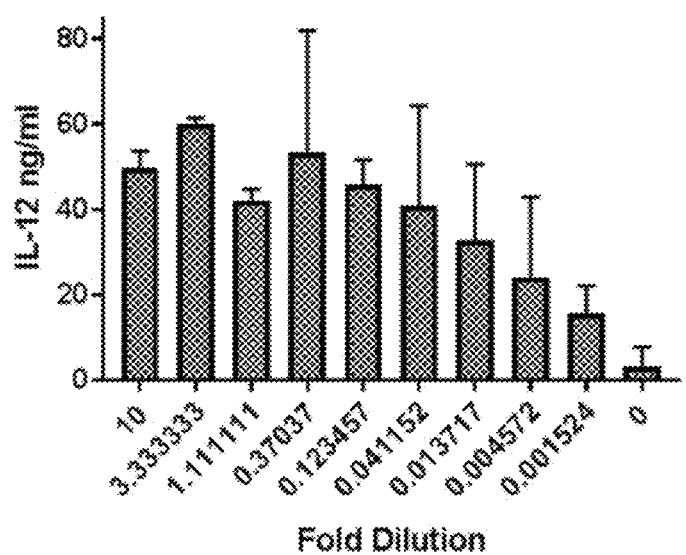

The dependence of functional IL12 production on the dose of Shield-1 used was measured. 10,000 HEK293T cells stably transduced with OT-IL12-004 were plated onto 96 well plates and treated with growth media containing 10, 3.33, 1.11, 0.37, 0.12, 0.04, 0.01, 0.005, 0.002 or 0 μM Shield-1 for 24 hours. Following Shield-1 treatment, media from cells was diluted 200-fold and 20 μL of the diluted media was added to HEK Blue sensor cells. After overnight incubation, 20 μl of media was removed from each well and incubated with 180 μl Quanti-Blue reagent (InvivoGen, San Diego, Calif.) for 30 minutes at 37° C. Absorption was measured at 620 nm using a spectrophotometer. To generate a standard curve, 180 µl Quanti-Blue reagent was mixed with 20 µl of recombinant IL12 at following concentrations 500, 250, 125, 62.5, 31.25, 15.62, 7.8 and 3.9 pg/ml. Functional IL12 concentrations were determined by comparing the optical density of each sample with IL12 standard curve. A dose dependent increase in the levels of functional IL12 levels was observed (FIG. 31B).

Example 31. DD Regulated Recombinant IL12 Expression In Vivo

Figure 31C:
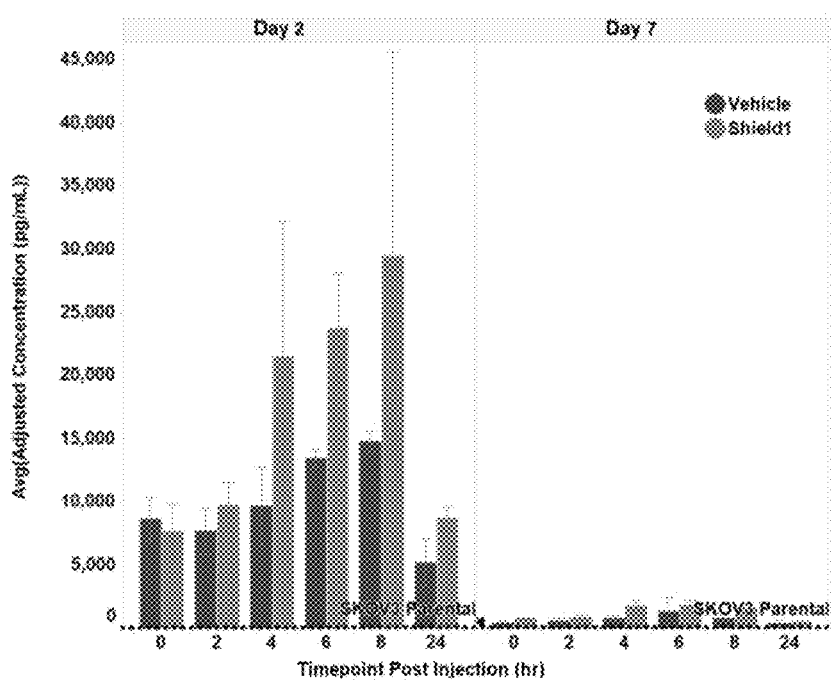

SKOV3 tumor cells expressing FBP regulated-112 (#OT-IL12-009) or parental cells were implanted into SCID Beige mice (Day 0). Mice implanted with FKBP IL12 were dosed intraperitoneally with Shield-1 (10 mg/kg) or vehicle control on Day 2 and Day 7, while the parental cells were left untreated. Blood samples were collected at 0, 2, 4, 6, 8 and 24 hours after Shield-1 dosing and plasma human IL12 levels were measured using ELISA. The average adjusted concentration of plasma IL12 is presented in FIG. 31C. At Day 2, IL12 levels increased in Shield-1 treatment and the levels were higher than vehicle control at 4, 6, 8, and 24 hours. Maximum IL12 levels were detected in Shield-1 treated mice at 8 hours following treatment. In contrast, at day 7, IL12 levels were very low and almost comparable to the IL12 levels in parental SKOV3 cells.

Figure 31D:
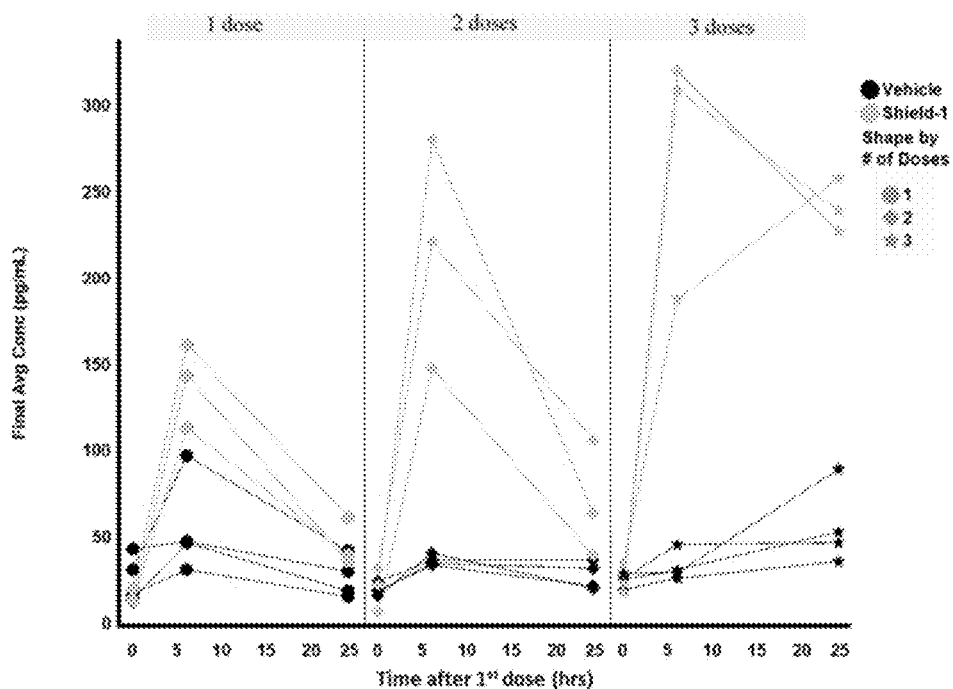

The experiment was repeated 28 days following implantation of SKOV3 tumor cells. Mice were split into three groups, with the groups receiving 1, 2 or 3 doses of ligand or vehicle control. Mice received multiple doses with a two-hour interval. Blood samples were collected right before the first dose (0 hours), and 6 hours and 24 hours after the first dosing. Plasma IL12 levels were measured and average IL12 concentrations are shown in FIG. 31D. The two dose and three dosing scheme resulted in higher plasma IL12 levels when compared to vehicle treated samples. Peak plasma IL12 levels was detected at 6 hours following shield-1 treatment with all dosing schemes, and the highest IL12 plasma levels were detected with the three-dose regimen. This demonstrates the ligand dependent stabilization of IL12 in vivo.

Example 32. DD Regulated IL15

To test ligand dependent IL15 production, 1 million HEK-293T cells were plated in a 6-well plate in growth media containing DMEM and 10% FBS and incubated overnight at 37° C. at 5% CO2. Cells were then transfected with 100 ng of OT-IL15-001 (constitutive) or OT-IL15-002 (ecDHFR-IL15) using Lipofectamine 2000 and incubated for 48 hrs. Following the incubation, media was exchanged for growth medium with 10 µM Trimethoprim or vehicle control and further incubated for 24 hrs. Media was collected and the undiluted samples or samples diluted 4, 16, 256, 1024, 4096 or 16384-fold were tested using human IL15 ELISA. The stabilization ratio was defined as fold change in IL15 expression with ligand treatment compared to treatment with DMSO (i.e. in the absence of ligand) with the same construct. Stabilization ratio greater than 1 is desired. Average IL15 ELISA readings and stabilization ratio are presented in Table 80.

TABLE 80

| | DD-IL15 induction | | |
|---|---|---|---|
| Media dilution (fold) | Vehicle | 10 µM TMP | Stabilization ratio |
| 1 | 0.396 | 0.820 | 2.073 |
| 4 | 0.154 | 0.287 | 1.867 |
| 16 | 0.074 | 0.116 | 1.567 |
| 64 | 0.056 | 0.073 | 1.301 |
| 256 | 0.053 | 0.057 | 1.075 |
| 1024 | 0.053 | 0.048 | 0.910 |
| 4096 | 0.049 | 0.049 | 0.995 |
| 16384 | 0.050 | 0.049 | 0.994 |

The 16-fold, 4-fold diluted, and undiluted media samples showed stabilization ratio greater than 1.5, suggesting a Trimethoprim dependent stabilization of IL15 at these dilutions.

Example 33. In Vitro T Cell Assay Development

Figure 32:
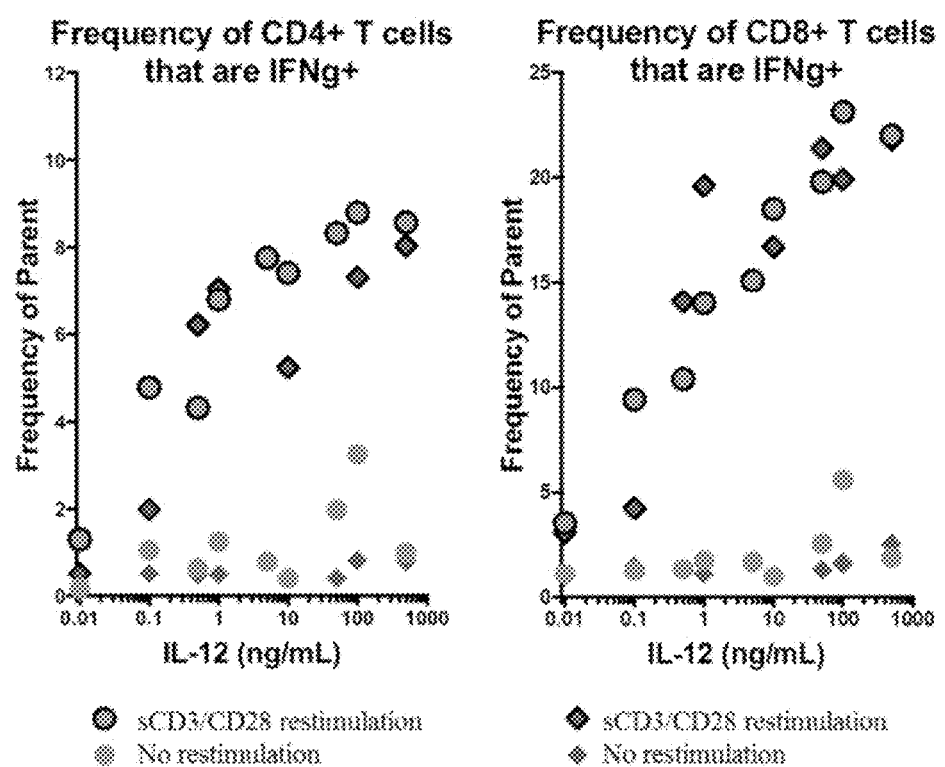
FIG. 32 denotes the frequency of IFNgamma positive T cells.

The goal of the study was to determine the T cell stimulation regimen and dose of IL12 needed to maximize T cell persistence and T cell differentiation in vitro, to mimic an in vivo adoptive cell transfer therapy regimen. The study recapitulates the design of the adoptive cell therapy regimen wherein the T cells were initially exposed to the antigen in vitro which results in activation followed by a resting phase and finally in vivo transfer where the T cells encounter the antigen again. T cells were stimulated CD3/CD28 beads or soluble CD3/CD28 on day 0 and the CD3/CD28 stimulus was washed off at the end of 48 hours. Cells were treated with a dose of IL12 ranging from 0.01-1000 ng/mL. On day 9, the Th1 phenotype of the cells was evaluated by examining the frequency of IFNgamma positive CD4+ cells and CD8+ cells. On day 14, cells were divided into two groups—one group received a second CD3/CD28 stimulation and a second group that was not stimulated. On day 16, the Th1 phenotype was evaluated in both groups using FACS. The results for day 16 are presented in FIG. 32. IFN gamma expression was higher in cells that received a CD3/CD28 restimulation on day 14 compared to cells that did not receive second stimulation. This indicates that both antigen restimulation and cytokine exposure are required for the Th1 phenotype. Further, as little as 0.1 ng/mL of IL12 could cause Th1-skewing and IFN gamma production from T cells in vitro, and higher doses of IL12 further improved this effect.

Example 34. Measuring Human T Cell Responses In Vitro and In Vivo

Figure 33A:
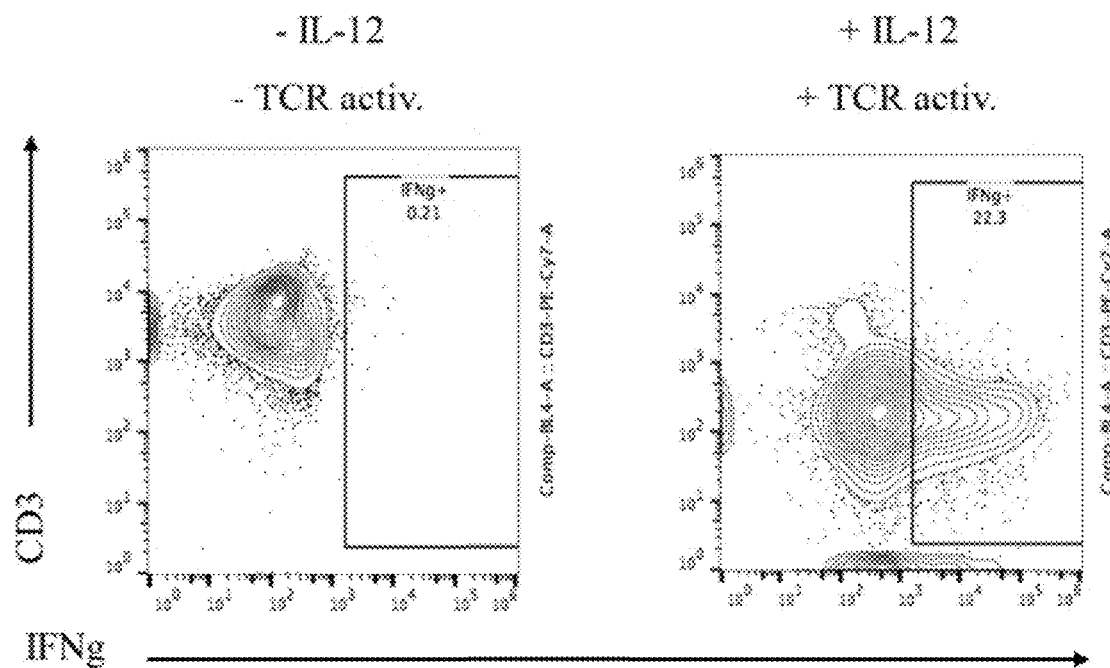
FIG. 33A-FIG. 33D depict analysis of human T cell responses in vitro and in vivo.

IL12 promotes the differentiation of naïve T cells into Th1 cells which results in the secretion of IFN gamma from T cells. Human T cells were treated with IL12 or left untreated and analyzed by flow cytometry for the expression of IFN gamma and T cell marker CD3. Treatment with IL12 resulted in the differentiation of T cells as measured by an increase in the percentage of IFN gamma positive T cells from 0.21 to 22.3 (see inset of FIG. 33A).

Figure 33B:
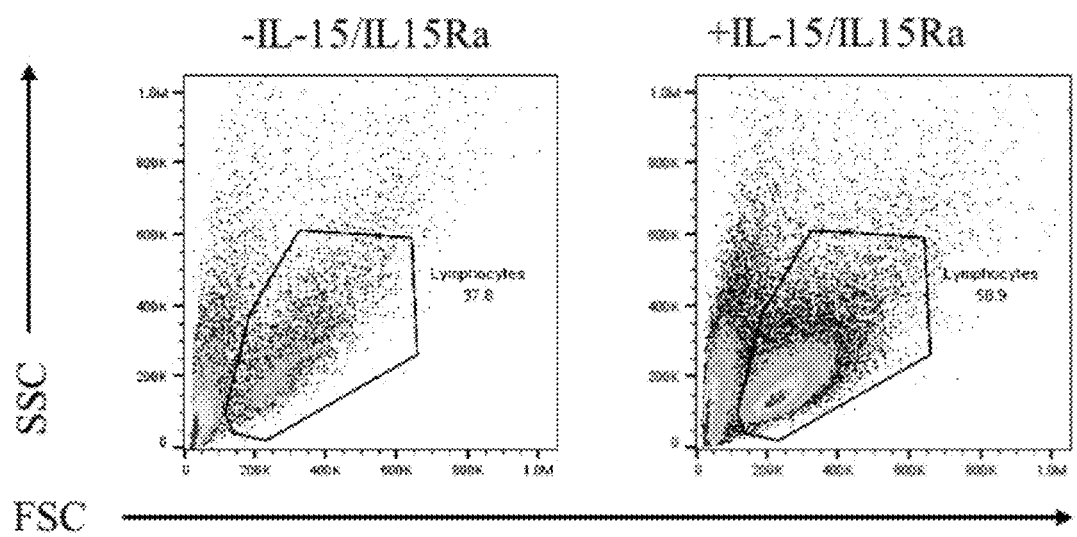

To test if membrane bound IL15/IL15Ra fusion protein (OT-IL15-008) can induce human T cell expansion, human T cells were transduced with the construct. T cell proliferation was measured by evaluating forward and side scatter of the T cell population using flow cytometry. Transduction with membrane bound IL15/IL15Ra fusion construct resulted in the expansion of human T cells (58.9) compared to control untransfected cells (37.8) (FIG. 33B).

Figure 33C:
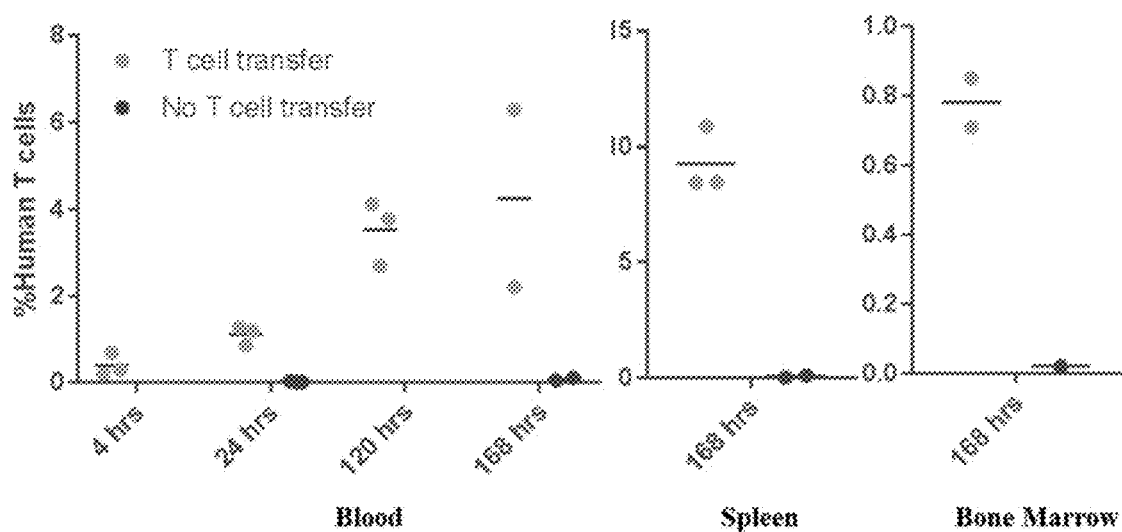

Tracking T cells following their adoptive transfer is critical to determine their distribution at different sites in the host, their identity and persistence over time. Human T cells were stimulated with CD3/CD28 beads and incubated with 50U/ml of IL2. Cells were expanded in vitro for 7 days with IL2 supplementation on day 3 and day 5. On day 5, the CD3/CD28 beads were removed and the cells were cultured for two days. On day 7, cells were washed to remove IL2 and 5 million human T cells were injected intravenously into immune compromised, NOD.Cg-Prkdc$^{scid}$ Il2rg$^{tm1Wjl}$/SzJ mice. Blood samples were obtained 4, 24, 120 and 168 hours after cell transfer. Mice were euthanized 168 hours after cell transfer and the bone marrow and spleen were harvested. Immune cells were isolated from all samples and analyzed for the presence of human T cells using CD3 and CD45 cell surface markers. As shown in FIG. 33C, the percentage of CD3 positive, CD45 positive human T cells in the blood was higher in animals injected with human T cells, especially at 120 and 168 hours. CD3 positive, CD45 positive human T cells were also detected in the spleen and bone marrow of animals injected with human T cells. As expected no CD3 positive, CD45 positive human T cells were detected in control animals that were not injected with human T cells.

Figure 33D:
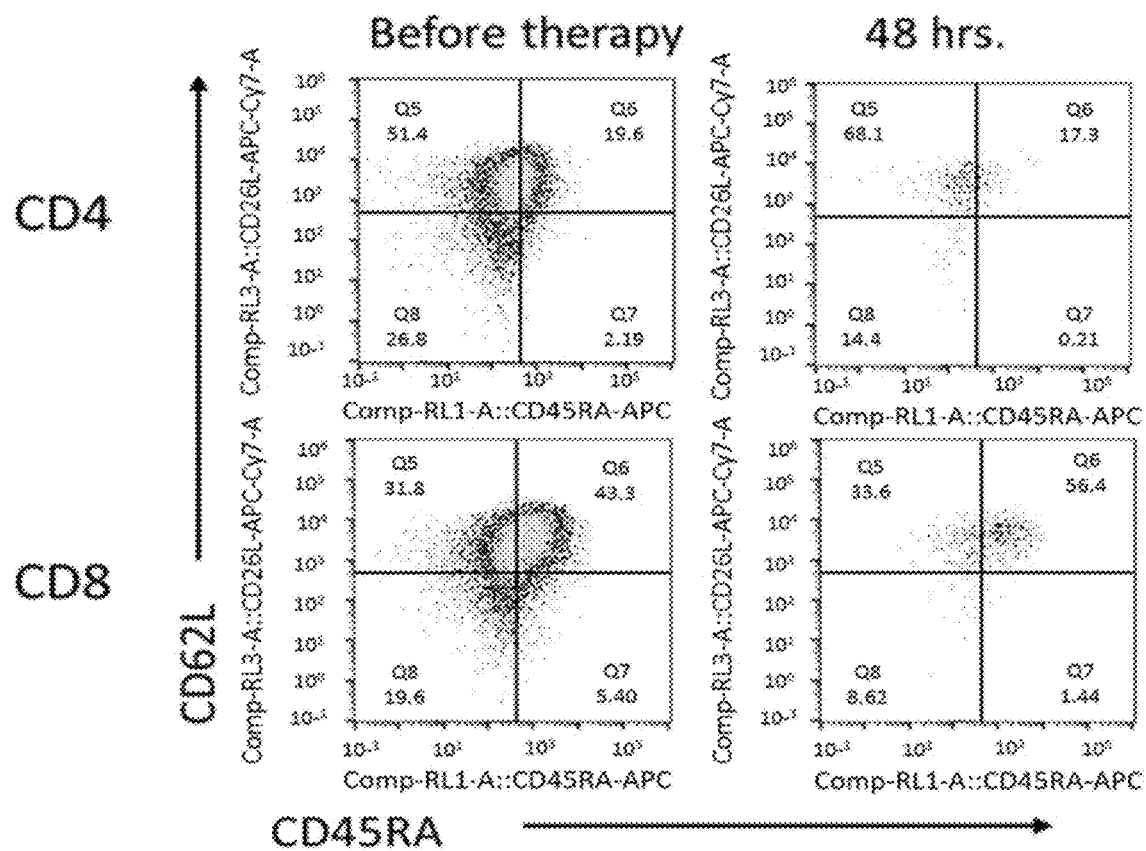

To determine the identity of the T cells following adoptive transfer, blood samples were collected from mice 48 hours after injection. CD4 and CD8 T cells were analyzed for surface expression of CD45RA and CD62L. Both markers are highly expressed in naïve T cells but are lost as the T cells become antigen exposure. As shown in FIG. 33D, human CD4 and CD8 T cells showed high surface expression of both markers prior to injecting into mice, but was lost 48 hours after in vivo cell transfer indicating that the human T cells are exposed to the antigen in vivo.

Example 35. DD Regulated IL12 Mediated Functions

DD-IL12 function is characterized in vivo by evaluating the ability of tumor cells expressing these constructs to establish tumors and proliferate under the treatment of corresponding synthetic ligands e.g. Shield-1, Trimethoprim or Methotrexate. 2-10 million HCT-116 cells stably transduced with the constructs are subcutaneously xenografted with 50 matrigel into mice capable of producing functional B and NK cells. Approximately, two weeks after injection, when the tumors reach a size of approximately 300 cubic mm, mice are dosed with corresponding stabilizing ligands e.g. Shield-1, Trimethoprim or Methotrexate at varying concentrations every two days. Shield-1 is injected with a carrier consisting of 10% Dimethylacetamide, 10% Solutol HS15, and 80% saline. Tumor volume and body weight are monitored twice a week and the experiment is terminated once the tumors reach 1000 cubic mm in size. Plasma and tumor samples are collected 8 hours after the last dose of the ligand and IL12 as well as the ligand levels are measured.

To evaluate the ability of IL12 expressing cells to form tumors, HCT-116 cells stably transduced with DD-IL12 constructs are pretreated with corresponding stabilizing ligands, Shield-1, Trimethoprim or Methotrexate and subsequently xenografted into mice. Reduction in tumor growth and a concomitant increase in IL12 levels in ligand treated mice compared to untreated controls is indicative conditional regulation of IL12 in vivo.

Example 36. DD Regulated Recombinant IL2 Mediated Functions in T Cells

Functional responses to DD-IL12 is evaluated in primary human T cells and in human cell lines/transformed hematopoietic cell lines e.g. Raji cells. Human T cells are purified from peripheral blood mononuclear cells (PBMCs) by negative selection using CD4+ T-cell isolation kit (Miltenyi Biotec, Germany). T cells are treated with growth media from HEK 293T cells expressing DD-IL12 constructs for 5 days. Cells are then activated with beads conjugated with-CD3/CD28 beads (Thermo Fisher Scientific, Waltham, Mass.) at the ratio of 3 beads per T cell and cultured for 3 days. Functional response to DD-IL12 is determined by measuring Interferon gamma in CD3 positive cells using flow cytometry IL12 promotes the differentiation of naïve T cells into Th1 cells which results in the secretion of IFN gamma from T cells.

To evaluate IL12 induced phosphorylation of STAT4 (Signal transducer and activator of transcription 4), human T-cells are isolated from PBMCs and activated with phytohemagglutinin (PHA, 2 µg/ml) for 3 days followed by treatment with 50 IU/ml of Interleukin-2 (IL2) for 24 hrs. Cells are then washed, resuspended in fresh media and rested for 4 hrs. Supernatant from DD-IL12 expressing HEK293T cells is added to the primary cells, followed by incubation for 30 minutes. Cells are then harvested and STAT4 phosphorylation is analyzed using STAT4 antibody (Cell Signaling Technology, Danvers, Mass.).

Example 37. Functional Analysis of DD Regulated IL15-IL15Ra Fusion Molecule

Activation via IL15 can sustain T cell persistence by conferring a survival advantage. In addition, IL15/IL15Ra fusion molecule has been shown to confer a memory phenotype on T cells and increase proliferation of NK cells (Hurton (2016), PNAS, 113: E7788-7797; the contents of which are incorporated herein by reference in their entirety).

To evaluate signaling by DD regulated IL15-IL15Ra fusion constructs, NK92 cells are incubated with HCT-116 cells expressing DD regulated IL15-IL15Ra fusion constructs. Trans signaling by IL15/IL15Ra is expected to increase STAT5 phosphorylation in NK92, which is measured by western blotting, and by FACS. Proliferation of NK92 cells is also measured.

To evaluate the effect of DD regulated IL15-IL15Ra fusion constructs on primary T cells, cells are transduced with the fusion constructs. T cell proliferation in the absence of exogenous IL5S supplementation is measured. The T cell memory phenotype is measured by quantifying CD62L expression by FACS.

To assess if DD-IL15/IL15R expressing T cells maintain prolonged persistence in vivo, DD modified T cells are injected into mice. Constructs are tagged with luciferase reporter to allow in vivo tracking in mice. Mice are treated with vehicle control or corresponding ligand, Shield-1, Trimethoprim or Methotrexate depending on the construct utilized and monitored over a period of 40-50 days using bioluminescent imaging (PerkinElmer, Mass.). Mice treated with ligand are expected to retain T cells expressing DD-IL15/IL15Ra while T cells in vehicle control treated animals are not expected to persist.

Example 38. DD Regulated CD19 CAR Expression and Function in T Cells

Ligand dependent expression of DD-CD19 CAR constructs is evaluated in primary human T cells and in immortalized/transformed hematopoietic cell lines e.g. Raji cells, Jurkat cells and K562 cells. Human T cells are purified from peripheral blood mononuclear cells (PBMCs) by negative selection using CD4+T− cell isolation kit (Miltenyi Biotec, Germany). Primary T cells and hematopoietic cell lines are stably transduced with DD-CD19 CAR constructs. Cells are treated with 10 μM Shield-1, 10 μM Trimethoprim, 1 μM Methotrexate or vehicle control and immunoblotted for CD3 Zeta using anti CD247 antibody.

The production of functional DD-CD19 CAR is analyzed in primary human T cells or human cell lines (NALM6, K562, Jurkat and Raji cells). Cells are incubated with CD19 expressing antigen presenting cells or CD19/Fc fusion protein in the presence of DD stabilizing ligands Shield-1, TMP or MTX. After incubation, cells are stained with fluorescently labelled anti-CD69 antibodies and analyzed by flow cytometry. Cells with high CD69 expression are considered to have a functional DD-CD19 CAR. Functional response to DD-CD19 CAR is also determined by measuring interferon gamma levels using ELISA. DD-CD19 CAR expressing cells are expected to demonstrate higher Interferon gamma levels in the presence of ligand than untreated cells.

Cytolytic potential of DD-CD19 CAR expressing cells is evaluated in primary human T cells or human cell lines (e.g. NALM6, K562 and Raji) using Chromium-51 Release Assay. Target cells are loaded with of $Na_2\ ^{51}CrO_4$, washed twice and resuspended in phenol red-free growth medium. Untreated or ligand treated DD-CD19 CAR and mock transduced cells are coincubated with CD19 expressing target cells at various effector: target cell ratios, and chromium release into the supernatant is measured using a liquid scintillation counter. Cells with DD-CD19 CAR are expected to demonstrate specific cytolysis only in the presence of ligand. Cells with DD-CD19 CAR in the absence of ligand or mock transfected cells are expected to show minimal cytolytic activity.

The in vivo antitumor efficacy of DD-CD19 CAR is also evaluated. Immune compromised mice are injected with luciferase expressing human leukemic cell lines (NALM-6). Subsequently, mice are injected with DD-CD19 CAR T cells via tail vein injections. Mice are subdivided into treatment groups and are treated with a range of ligand doses. Two control groups are also included in the study: a control group that did not receive any ligand and another group that did not receive any T cells. Tumor burden as measured by luciferase activity is monitored over time using bioluminescent imaging. Mice treated with DD-CD19 CAR T cells and ligand are expected to have a reduced tumor burden when compared to control animals.

Example 39. Evaluation of Antitumor Response of DD Regulated Payloads in Syngeneic Mouse Models The efficacy of cancer immunotherapy in organisms with intact immune cells is evaluated using syngeneic mouse models e.g. pMEL-1 and 4T1 mouse models. Immune cells such as T cells and NK cells are isolated from syngeneic mice and transduced with DD regulated payloads such as DD-IL2, DD-IL12, DD-IL12 with DD-IL15 or DD1L15-IL15Ra, DD-IL15, DD1L15-IL15Ra, DD-CD19 CAR, and DD-caspase9. Cells are then injected into mice bearing subcutaneous syngeneic tumors and treated with varying concentrations of ligand, Shield-1, Trimethoprim or Methotrexate, depending on the DD used. Mice treated with immune cells transduced with DD regulated payload are expected to have a reduced tumor burden when compared to control animals.

Example 40. Optimizing Workflow for Discovery of DD-Regulated Immunotherapeutic Agents To identify DD-CD19 CAR constructs suitable for immunotherapy, constructs are introduced into cell lines e.g. HEK293T cells and Jurkat cells. The expression of the construct in the presence or absence of the corresponding ligand is tested. Constructs which show low basal expression in the absence of ligand and robust, ligand-dose responsive expression are selected for further analysis. If no DD-CD19 CAR constructs show ligand-dependent expression, then constructs are redesigned and the experiment is repeated till a regulatable construct is identified. Next, the ligand dependent regulation of the DD-CD19 CAR constructs is tested in vitro in primary T cells. If the constructs show low basal expression in the absence of the ligand and ligand dose responsive expression, they are subject to in vivo PK/PD proof of concept experiments. Otherwise, the constructs are redesigned and the new constructs are subject to similar analysis. The constitutively expressing CD19 CAR constructs are transduced into T cells and CD19 CAR expression is measured in parallel to the regulated construct. If no expression is detected in vitro, efforts are refocused on testing DD-CD19 CAR constructs in vitro in T cells. In contrast, if the constitutive constructs show expression, then the expression of CD19 CAR is measured in vivo.

To test in vivo PK/PD, mice are injected with T cells expressing DD-CD19 CAR constructs and the test group is dosed with the ligand corresponding to the DD, while the control group is dosed with the appropriate vehicle control. Constructs that display ligand-dependent expression of CD19 CAR are selected for in vivo functional proof of concept experiments. Parallel experiments are also conducted using the constitutive CD19 CAR constructs. If constitutive CD19 CAR expression is detected in vivo, then the constructs are selected for functional experiments. If no expression is detected in vivo, then constructs are redesigned.

Functional analysis in vivo is performed by testing if the constitutive and DD regulated CD19 CAR expressing T cells display anti-tumor activity in a constitutive or ligand dependent manner respectively. If yes, then in vivo proof of concept is achieved and constructs suitable for immunotherapy are identified. If none of the DD regulated constructs show anti-tumor activity, then alternate dosing regimens are explored. If the constitutive CD19 CAR constructs do not show anti-tumor activity, then efforts are focused on identifying DD-CD19 CAR constructs that show in vivo expression in T cells.

Example 41. Optimizing Workflow for Discovery of DD-Regulated Immunotherapeutic Agents To identify DD-IL15/IL15Ra constructs suitable for immunotherapy, constructs are introduced into cell lines e.g. HEK293T cells and Jurkat cells. The expression of the construct in the presence or absence of the corresponding ligand is tested. Constructs which show low basal expression in the absence of ligand and ligand-dose responsive expression are selected for further analysis. If no DD-IL15/IL15Ra constructs show ligand-dependent expression, then constructs are redesigned and the experiment is repeated till a regulatable construct is identified. Next, the ligand dependent regulation of the DD-IL 15/IL15Ra constructs is tested in vitro in primary T cells. If the constructs show low basal expression in the absence of the ligand and ligand dose responsive expression, they are subject to in vivo pharmacokinetics/pharmacodynamics (PK/PD) proof of concept experiments. Otherwise, the constructs are redesigned and the new constructs are subject to similar analysis. The constitutively expressing IL15/IL15Ra constructs are transduced into T cells and IL15-IL15Ra expression is measured in parallel to the regulated construct. If no expression is detected in vitro, efforts are refocused on testing DD-IL15/IL15Ra constructs in vitro in T cells. In contrast, if the constitutive constructs show expression, then the expression of IL 5/IL 15Ra is measured in vivo.

To test in vivo PK/PD, mice are injected with T cells expressing DD-IL 15/IL15Ra constructs and the test group is dosed with the ligand corresponding to the DD, while the control group is dosed with the appropriate vehicle control. Constructs that display ligand-dependent expression of IL15/IL15Ra are selected for in vivo functional proof of concept experiments. Parallel experiments are also conducted using the constitutive IL15/IL15Ra constructs. If constitutive IL15/IL15Ra expression is detected in vivo, then the constructs are selected for functional experiments. If no expression is detected in vivo, then constructs are redesigned.

The functional analysis in vivo is performed by testing if the constitutive and DD regulated IL15/IL15Ra constructs confer a survival advantage to the expressing T cells in a constitutive or ligand dependent manner respectively. If yes, then in vivo proof of concept is achieved and constructs suitable for immunotherapy are identified. If none of the DD regulated constructs show T cell persistence, then alternate dosing regimens are explored. If the constitutive IL15/IL15Ra constructs do not confer proliferative advantage, then efforts are focused on identifying DD-IL15/IL15Ra constructs that show in vivo expression in T cells.

Example 42. Optimizing Workflow for Discovery of DD-Regulated Immunotherapeutic Agents To identify DD-IL12 constructs suitable for immunotherapy, constructs are introduced into cell lines e.g. HEK293T cells and Jurkat cells. The expression of the construct in the presence or absence of the corresponding ligand is tested. Constructs which show low basal expression in the absence of ligand and ligand-dose responsive regulation are selected for further analysis. If no DD-IL12 constructs show ligand-dependent expression, then constructs are redesigned and the experiment is repeated till a regulatable construct is identified Next, the ligand dependent regulation of the DD-IL12 constructs is tested in vitro in primary T cells. If the constructs show low basal expression in the absence of the ligand and ligand dose responsive expression, they are subject to in vivo PK/PD proof of concept experiments. The constitutively expressing IL12 constructs are transduced into T cells and IL12 expression is measured in parallel to the regulated construct. If no expression is detected in vitro, efforts are refocused on testing DD-L12 constructs in vitro in T cells. In contrast, if the constitutive constructs show expression, then the expression of IL12 is measured in vivo.

To test in vivo PK/PD, mice are injected with T cells expressing DD-IL12 constructs and the test group is dosed with the ligand corresponding to the DD, while the control group is dosed with the appropriate vehicle control. IL12 expression is measured in the plasma of animals. Constructs that display ligand-dependent expression of IL12 are selected for in vivo functional proof of concept experiments. Parallel experiments are also conducted using the constitutive IL12 constructs. If constitutive IL12 expression is detected in vivo, then the constructs are selected for functional experiments.

The functional analysis in vivo is performed by testing if the constitutive and DD regulated IL12 cause a detectable increase in IFN gamma production in the plasma in a constitutive or ligand dependent manner respectively. If yes, then in vivo proof of concept is achieved and constructs suitable for immunotherapy are identified. If none of the DD regulated constructs show IFNgamma, then alternate dosing regimens are explored. If the constitutive IL12 constructs do not produce IFNgamma, then efforts are focused on identifying DD-IL12 constructs that show in vivo expression in T cells.

Example 43. Co-Expression of DD Regulated Payloads

Toxicity related to systemic administration of interleukins can be circumvented by using CAR-T cells to deliver interleukins to the target tissue. This combinatorial approach also has greater anti-tumor activity than interleukin and CAR therapy alone. Cells are co-transfected with CD19 CAR (constitutive or DD regulated) and DD-Interleukin e.g. DD-IL12, DD-IL15 and DD-IL15/IL15Ra constructs. Transfected cells are treated with stabilizing ligands depending on the DD utilized. CD19 CAR expression is evaluated by immunoblotting for CD3 zeta. DD-IL12, DD-IL15 and DD-IL15/IL15Ra expression in the media is measured by ELISA.

Example 44. Co-Expression of DD Regulated Payloads

The co-expression of DD regulated payloads has the potential to confer greater anti-tumor activity than the single agent alone. Cells are co-transfected with DD-IL12 and DD-IL15 or DD-IL15/IL15Ra constructs. Transfected cells are treated with stabilizing ligands depending on the DD utilized. DD-IL12, DD-IL15 and DD-IL15/IL15Ra expression in the media is measured by ELISA.

Example 45. Co-Expression of DD Regulated Payloads

Cells are co-transfected with DD-Interleukin e.g. DD-IL2 and DD Caspase9 or DD FOXP3 constructs. Transfected cells are treated with stabilizing ligands depending on the DD utilized. DD-IL2, expression in the media is measured by ELISA. FOXP3 and caspase 9 expression are evaluated by immunoblotting for FOXP3 and caspase 9 respectively.

Example 46. CAR Expression and Functionality in T Cells

Figure 34A:
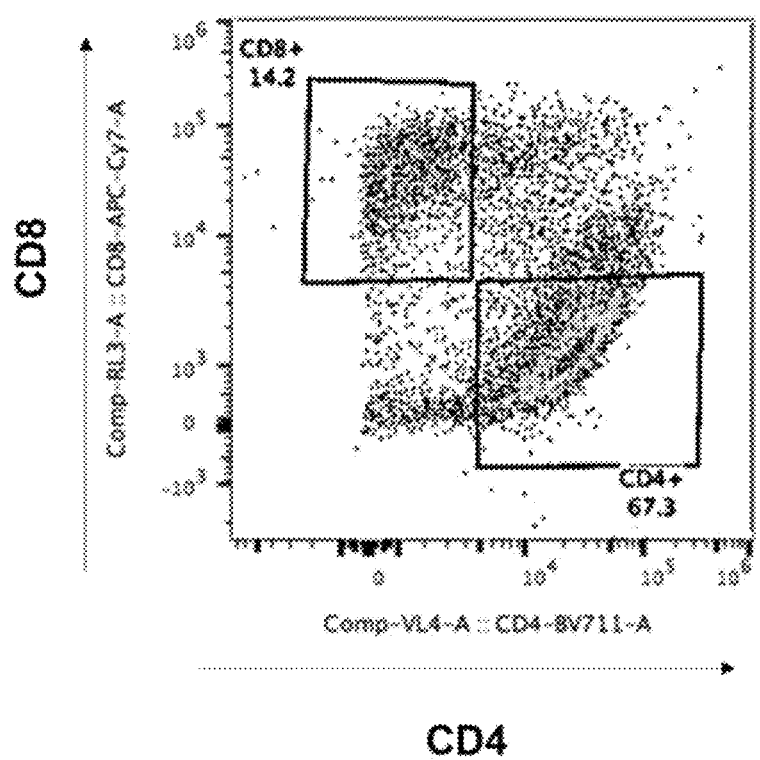
FIG. 34A-FIG. 34B show CAR expression and functionality in T cells.

Primary T cells were transduced with CD19 CAR constructs. Surface expression of CD19 CAR construct was measured using Fluorescence activated cell sorting (FACS) with Protein L-Biotin-Strepavidin-Allophycocyanin which binds to the kappa light chain of the CAR (ThermoFisher Scientific, Waltham, Mass.). To determine the percentage of the CD4 and CD8 sub populations of CAR T cells, cells were analyzed by anti CD4, anti CD8 antibodies and Protein L. As shown in FIG. 34A, 67.3% of CAR positive cells obtained were CD4 positive, while only 14.2% cells were CD8 positive.

Figure 34B:
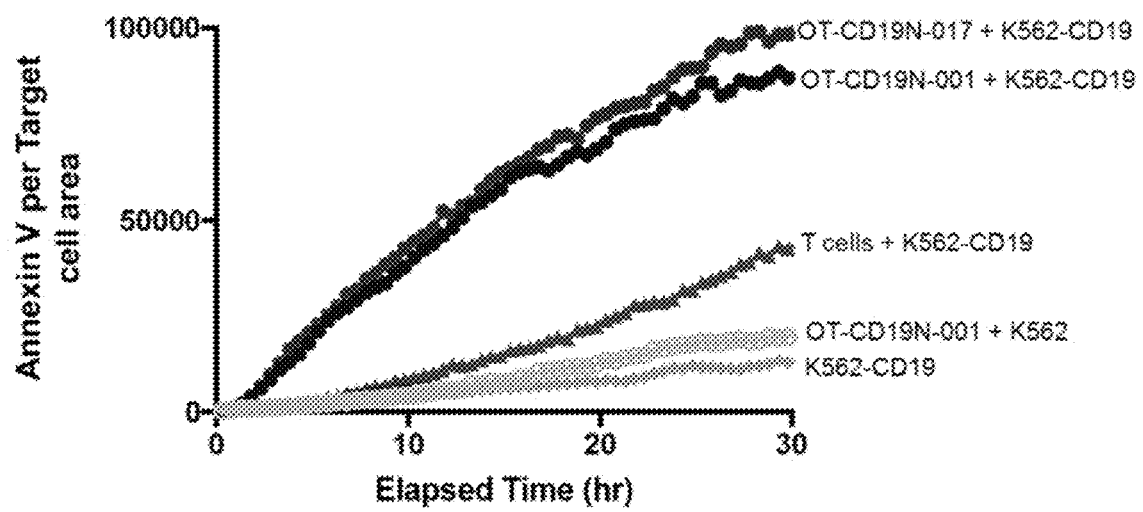

To test the ability of CD19 CAR cells to kill target cells, primary T cell populations transduced with OT-CD19N-001 or OT-CD19N-017 were cocultured with K562 cells expressing CD19 (target cells) at a ratio of 5:1. Additional control combinations of T cells and target cells were also set up. These included CAR expressing T cells co cultured with K562 cells, T cells co cultured with K562 cells expressing CD19 and K562 cells expressing CD19 without T cell co culture. K562 cells were fluorescently labelled with NucLight Red and co cultured with T cells for 30 hours. Cell death was monitored by labelling cells with Annexin V and K562 target cell death was measured by evaluating Annexin V staining in NucLight Red positive cells. The ratio of Annexin V staining per target cell area was calculated. As shown in FIG. 34B, OT-CD19N-001 or OT-CD19N-017 expressing T cells were effective in killing target K562 cells expressing CD19. A low level of target cell killing was observed when untransduced T cells were cocultured with CD19 expressing target cells. As expected, cell death was minimal in the co-culture of OT-CD19N-001 expressing T cells and K562 cells (without CD19 expression). These data show that CD19 CAR cells are effective in killing their corresponding target cells.

Example 47. Regulated Expression of IL15-IL15Ra in T Cells

Figure 35A:
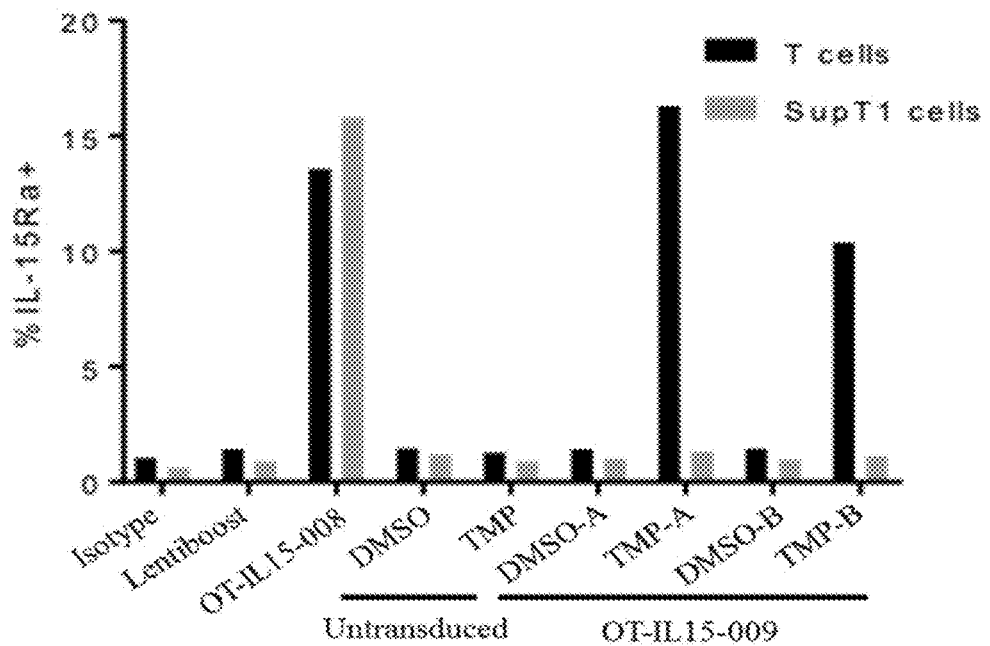
FIG. 35A-FIG. 35C shows expression analyses of IL15-IL15Ra in T cells.
Figure 35B:
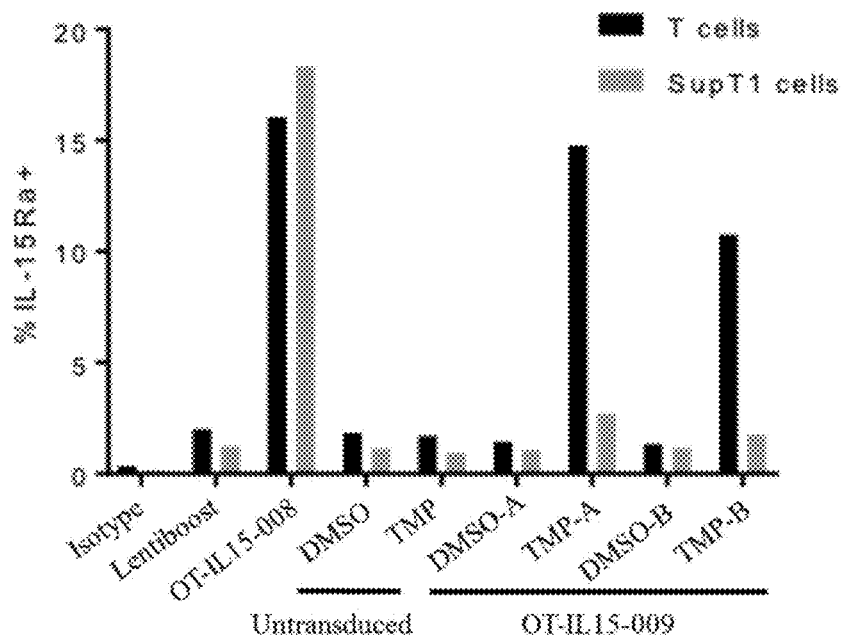

DD regulated IL15-IL15Ra constructs such as OT-IL15-009 or constitutively expressed constructs such as OT-IL15-008 were transduced into T cells such as primary T cells or SupT1 cells. The transduction was carried out at two different lentivirus concentrations, 5 µl and 20 µl for the DD regulated construct using Lentiboost™ (Sirion Biotech, Germany). 4 days after transduction, cells were treated with 10 µM TMP or DMSO control for 24 and 48 hours. Samples were analyzed with an anti IL15Ra antibody using FACS. Additional controls samples such as cells treated with Lentiboost only, untransduced cells treated with DMSO or TMP, and Isotype controls were included in the FACS analysis. The FACS results are depicted in FIG. 35A for 24 hours of TMP treatment and in FIG. 35B for 48 hours of TMP treatment. In both figures, DMSO-A and TMP-A represent cells treated with 5 µl of lentivirus and DMSO-B and TMP-B reprsent cells treated with 20 µl of lentivirus. Treatment of T cells expressing OT-IL15-009 with TMP for 24 hours resulted in an increase in the expression of IL15Ra in T cells with both doses of lentivirus used. Additionally, very low levels of IL 5Ra were detected in the DMSO treated samples under the same conditions as well as in the untransduced T cells. As expected, the constitutively expressed construct, OT-IL15-008 showed high expression of IL15Rα. TMP dependent expression of OT-IL15-009 was not observed in SupT1 cells (FIG. 35A). Similar results were observed for both T cells and SupT1 cells at 48 hours (FIG. 35B). These results show that tight regulation of IL15-IL15Ra constructs can be achieved in primary T cells.

The surface expression of IL15 and IL15Ra was measured for OT-IL15-008 and OT-IL15-009. The percentage of cells expressing L 15, IL15Ra or both on the cell surface is presented in Table 81.

TABLE 81

Surface expression of IL15 and IL15Ra

| | % Positive cells | |
|---|---|---|
| | OT-IL15-008 | OT-IL15-009 |
| IL15 and IL15Ra positive | 2.03 | 0.51 |
| IL15Ra positive | 13.0 | 15.8 |
| IL15 positive | 0.29 | 0.60 |

As shown in Table 81, the percentage of cells with detectable surface expression of IL15 and IL15Ra was less than 5% with both constructs. Further, the percentage of cells with surface expression of IL 5Ra was much higher than the percentage of cells with detectable surface expression of IL 15.

Figure 35C:
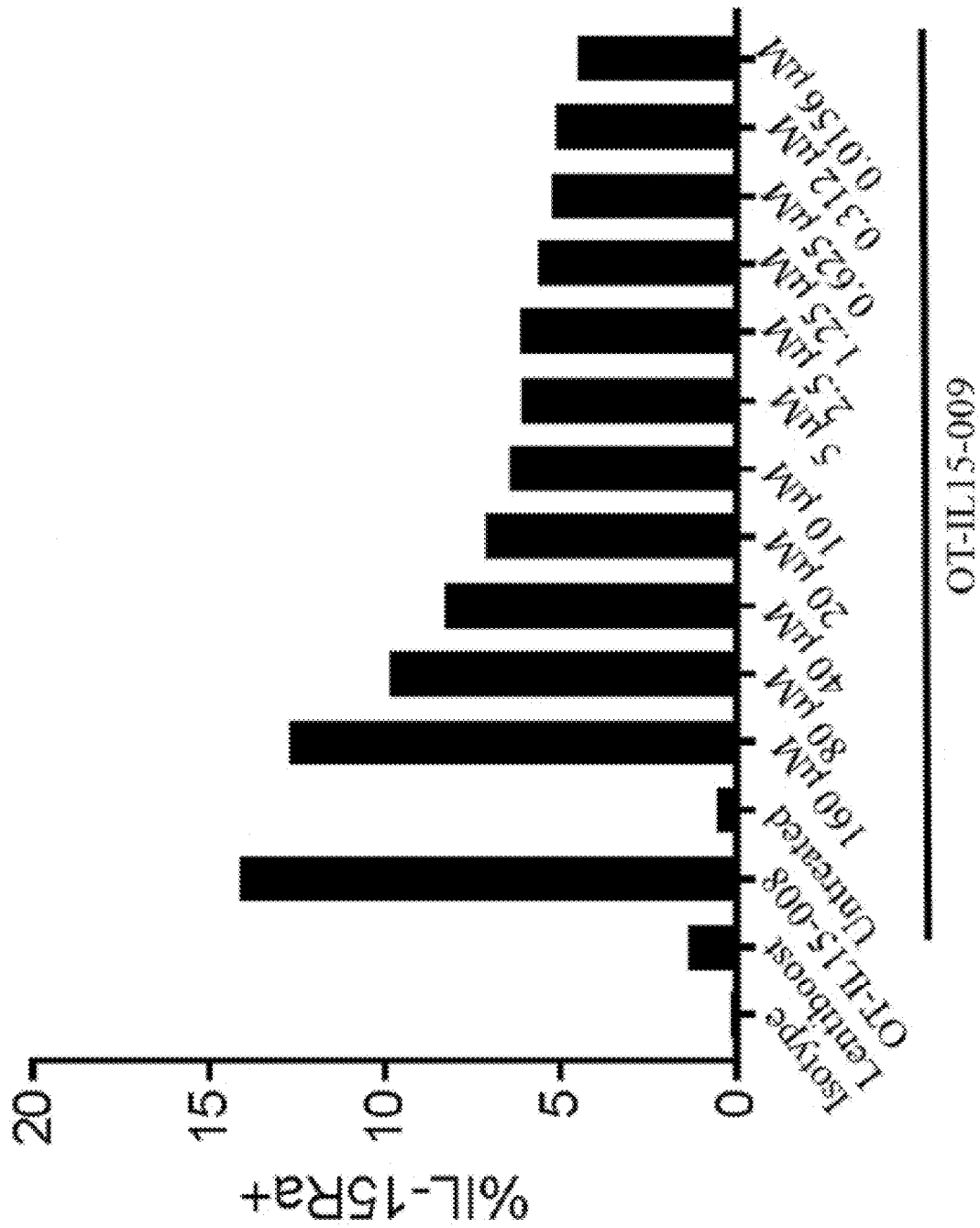

The effect of increasing doses of TMP on IL15Ra expression in T cells was measured using the OT-IL15-009 construct. T cells were treated with a range of doses of TMP starting from 0.156 µM to 160 µM for 24 hours. IL15Ra expression was measured using FACS. As shown in FIG. 35C, the percentage of IL15Ra expressing T cells with OT-IL15-009 cells was detected even at the lowest concentration of TMP and the percentage of IL15Ra positive cells at the lowest concentration of TMP was higher than the untreated control. An increase in the percentage of IL15Ra cells with increasing doses of TMP was observed.

Figure 36A:
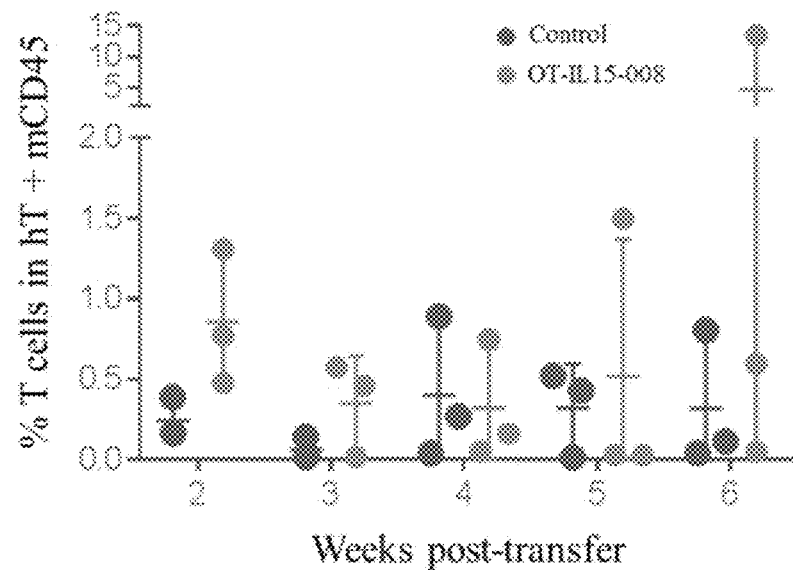
FIG. 36A-FIG. 36D show analyses of the effect of IL15-IL15Ra on T cell persistence and T cell memory phenotype.

Example 48. Effect of IL15-IL15Ra on T Cell Persistence and T Cell Memory Phenotype The effect of constitutively expressed IL15-IL15Ra fusion constructs on T cell persistence was measured in NSG mice. T cells were transduced with OT-IL15-008 and 4 million T cells were injected intravenously into NSG mice (number of mice=3). As a control, additional mice were injected with untransduced T cells. Blood samples were obtained from mice at 2, 3, 4, 5 and 6 weeks and analyzed by FACS for the presence of CD8 and/or CD4 positive human T cells expressing IL15 and IL15Ra. The percentage of human T cells in the blood was calculated as the percentage of total T cells i.e. human T cells (measured using anti-human CD45 antibody) and the mouse T cells and endothelial cells (measured using the anti-mouse CD45 antibody). As shown in FIG. 36A, the percentage of T cells in the blood at 2 weeks was greater in mice injected with T cells expressing OT-IL15-008 compared to control mice that were injected with untransduced T cells. This observed increase in T cells decreased over 3, 4, and 5 weeks, and the final percentage of T cells at 6 weeks was comparable between the two cohorts. At 6 weeks, one of the mice injected with OT-IL15-008 transduced T cells showed a higher percentage of human T cells in the blood, which may represent a graft versus host disease response. Thus, at 2 weeks, the frequency of human T cells in the blood is increased in the blood of mice injected with OT-IL15-008 transduced T cells.

Figure 36B:
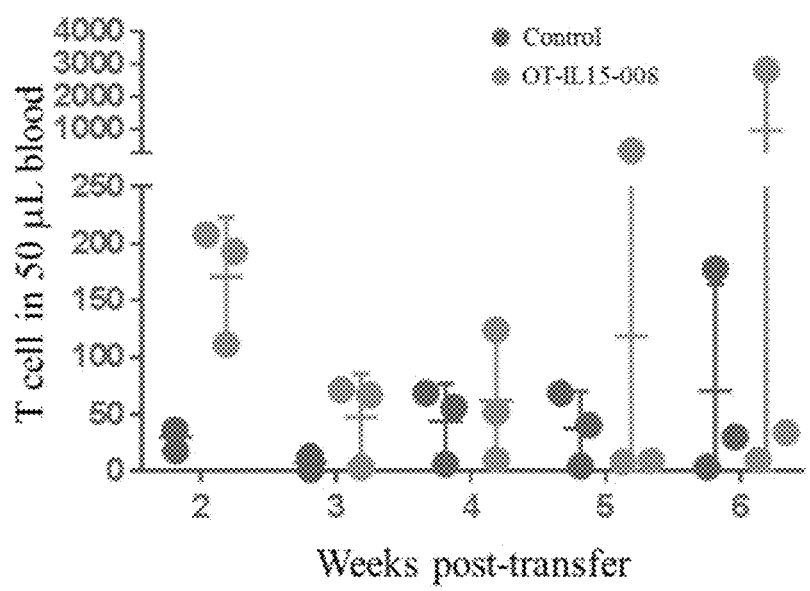

The number of T cells in the blood during the experiment was measured by comparing the number of human T cells in 50 uL of mouse blood was measured in the blood samples by FACS using anti-human CD45 antibody as a marker for human T cells and anti-murine CD3 antibody as a marker for murine endothelial cells. As shown in FIG. 36B, the number of human T cells in the blood increased at 2 weeks in mice injected with OT-IL15-008 transduced T cells, as compared to mice injected with untransduced T cells. The differential between the two cohorts was diminished at 3 weeks and 4 weeks. At 6 weeks, one of the mice injected with OT-IL15-008 transduced T cells showed a higher number of human T cells in the blood. Thus, at 2 weeks, the frequency and number of human T cells in the blood is increased in the blood of mice injected with OT-IL15-008 transduced T cells supporting the role of IL15-IL15Ra fusion proteins in T cell persistence. The increased T cell frequency and number observed at 6 weeks in one of the mice may be due to graft versus host disease.

Figure 36C:
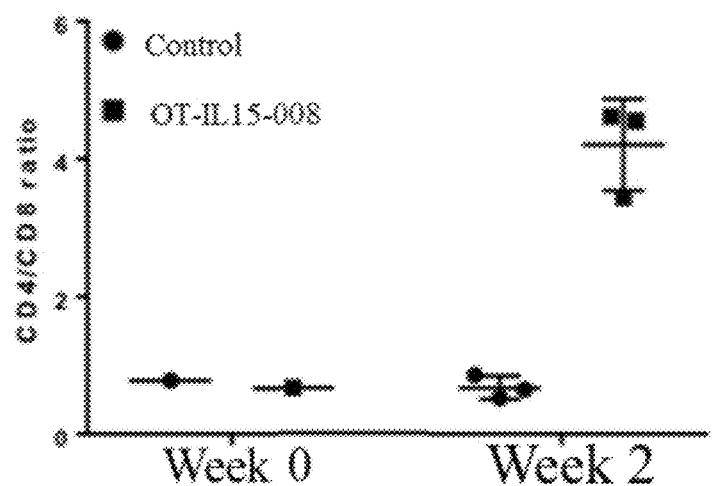
Figure 36D:
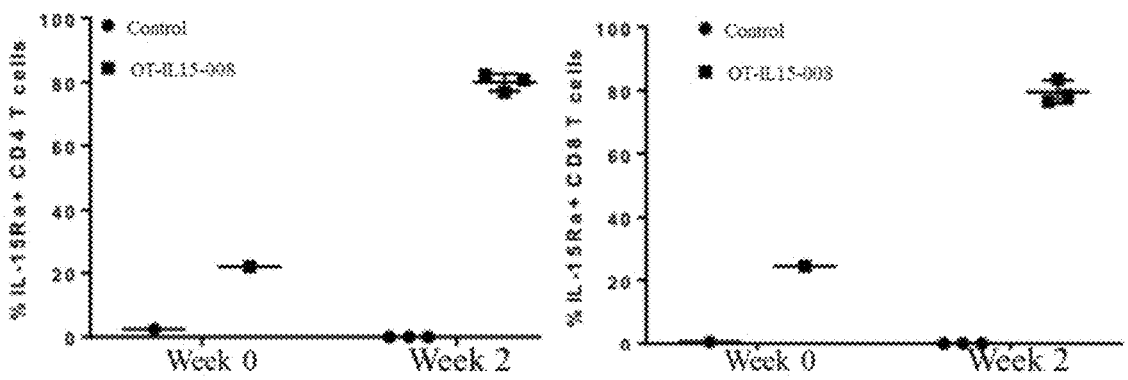

The effect of OT-IL15-008 expression on the CD4 and CD8 subset of T cells was measured prior to injecting into mice (Week 0) and 2 weeks after injection. As shown in FIG. 36C, the ratio of CD8 and CD4 cells was 1:1 prior to injecting into mice. However, at 2 weeks, the proportion of CD8 positive cells was much higher than the CD4 positive cells in the transduced cells, indicating that OT-IL15-008 causes a preferential expansion of CD8 positive cells. The expression of the OT-IL15-008 construct within the CD4 and CD8 subsets was measured using anti IL15Ra antibody. As shown in FIG. 36D, prior to injections, 25% of the OT-IL15-008 transduced CD4 T cells and CD8 T cells expressed IL15Ra. At week 2, the percentage of IL15Ra positive CD4 and CD8 T cells increased to 80% indicating a preferential expansion of T cells transduced with OT-IL15-008. As expected, untransduced control T cells were negative for IL15Ra expression.

Example 49. IL12 Dependent, Re-Stimulation Independent Th1 Markers

T cells require T cell receptor restimulation in vivo or in vitro stimulation with CD3/CD28 to produce IFNgamma. To study the effect of IL12 activity on T cells in the absence of restimulation, several T cell markers were explored. T cells were expanded using one of the following 4 expansions strategies (i) Day 10 cytokine switch from IL2 to IL12, CD3/CD28 stimulation from day 0 to day 10 with no restimulation (ii) Day 10 cytokine switch from IL2 to IL12, CD3/CD28 stimulation from day 0 to day 10 and restimulation at with CD3/CD28 from day 12 to day 14 (iii) Day 10 cytokine switch from IL2 to IL12, CD3/CD28 stimulation from day 0 to day 3 with no restimulation (iv) Day 10 cytokine switch from IL2 to IL12, CD3/CD28 stimulation from day 0 to day 3 and restimulation at with CD3/CD28 from day 12 to day 14. Markers tested include CD69, IFNg, Perforin, CXCR3, Granzyme B, CCR5, CXCR6, Ki-67 and T-bet. IFNg appears to be the most robust and consistent marker for IL12 activity on human T cells, but requires re-stimulation of T cells to induce production. Th1 markers which increase in response to IL12 in the absence of re-stimulation and IL2 (similar to in vivo conditions) include Ki-67, T-bet, Perforin, CXCR3, and CCR5.

Example 50. Effect of Cytokines on NK Cell Proliferation and Activation

Immune cells such as Natural Killer cells depend on cytokines such as IL15 for their proliferation and survival. This dependence on cytokines can be used to test the functionality of DD regulated or constitutively expressed cytokines and cytokine fusion proteins.

The dependency of the NK-92 cells on cytokines for activation was tested. Cells were initially cultured for 3 days with IL2, following which, cells were washed twice and cultured in media without IL2 for 7 hours. The cells were cultured for 18 hours in the presence of IL12 (10 ng/ml) or varying concentrations of IL15 (100 ng/ml, 20 ng/ml, 4 ng/ml, 0.8 ng/ml, 0.16 ng/ml, 0.032 ng/ml, 0.0064 ng/ml and 0.00128 ng/ml). NK-92 cell activation in response to IL15 and IL12 treatment was evaluated by FACS analysis using a panel of markers whose increased expression is associated with NK activation. These include NKG2D, CD71, CD69; chemokine receptors such as CCR5, CXCR4, and CXCR3, Perforin, Granzyme B and Interferon gamma (IFNg). Prior to FACS analysis for IFNg, cells were cultured for 4 hours with Brefeldin A. NK cells respond to external stimuli such as cytokines in their environment through the phosphorylation of proteins JAK/STAT, ERK, and p38/MAPK pathways which are important for cell activation, signaling and differentiation pathways. The phosphorylation of AKT, STAT3 and STAT5 in response to cytokine addition was measured by FACS. Since phosphorylation events are transient NK-92 cells were treated with the cytokines for 15 or 60 minutes, prior to the analysis. The fold change in mean fluorescence intensities compared to untreated for IL15 treatment are presented in Table 82.

TABLE 82

| | IL15 induced markers | | | | | | |
|---|---|---|---|---|---|---|---|
| IL15 dose (ng/ml) | CD69 | CXCR4 | Perforin | Granzyme B | pSTAT5 (15 mins) | pSTAT5 (60 mins) | IFNgamma |
| 100 | 1.91 | 3.87 | 1.67 | 1.48 | 1.98 | 2.34 | 9.00 |
| 20 | 2.10 | 3.62 | 1.57 | 1.40 | 1.96 | 2.35 | 5.55 |
| 4 | 1.59 | 3.03 | 1.28 | 1.16 | 1.81 | 2.35 | 2.76 |
| 0.8 | 1.18 | 2.10 | 1.16 | 1.09 | 1.76 | 2.17 | 1.92 |
| 0.16 | 0.99 | 1.41 | 1.04 | 1.03 | 1.44 | 2.08 | 2.41 |
| 0.032 | 1.05 | 1.14 | 0.92 | 0.92 | 1.23 | 1.67 | 0.95 |
| 0.0064 | 1.11 | 1.19 | 0.79 | 0.78 | 1.03 | 1.26 | 0.85 |
| 0.00128 | 1.07 | 1.15 | 0.85 | 0.88 | 0.99 | 1.04 | 1.19 |

Treatment with IL15 resulted in an increase in the expression of CD69, CXCR4, Perforin, Granzyme B, and IFNg. The effect of IL 15 on these markers was dose dependent with a higher dose of IL15 resulting in a corresponding upregulation of markers. Phosphorylation of STAT5 was increased both at 15 and 60 minutes after the addition of IL2 or L5. Taken together, these results show that cytokines can activate NK cells.

The fold change in activation markers observed with IL12 treatment are shown in Table 83.

TABLE 83

IL12 induced markers

| Marker | Fold change |
|---|---|
| CCR5 | 1.60 |
| Perforin | 1.67 |
| Granzyme | 1.87 |
| IFNg | 1.74 |
| IFNg (supernatant) | 666.15 |

Treatment with IL12 resulted in an increase in the expression of markers CD69, CCR5, Perforin, Granzyme B, and IFNgamma. Further, IFNg levels secreted by NK-92 cells into the media higher than untreated controls upon treatment with IL12. Treatment with IL2 resulted in an increase in the expression of CXCR4, Perforin, Granzyme B, and IFNg. Further, IFNg levels secreted by NK-92 cells into the supernatant was higher than untreated controls upon treatment with IL2.

Example 51. Effect of IL15 on NK Cell Proliferation and Activation

Immune cells such as Natural Killer cells depend on cytokines such as IL15 for their proliferation and survival. This dependence on cytokines can be used to test the functionality of DD regulated or constitutively expressed cytokines and cytokine fusion proteins.

The dependency of the NK-92 cells on cytokines for activation was tested. Cells were initially cultured for 3 days with IL2, following which, cells were washed twice and cultured in media without IL2 for 7 hours. The cells were cultured for 18 hours in the presence of varying concentrations of IL15 (100 ng/ml, 20 ng/ml, 4 ng/ml, 0.8 ng/ml, 0.16 ng/ml, 0.032 ng/ml, 0.0064 ng/ml and 0.00128 ng/ml). NK-92 cell activation in response to IL15 treatment was evaluated by FACS analysis using a panel of markers whose increased expression is associated with NK activation. These include NKG2D, CD71, CD69; chemokine receptors such as CCR5, CXCR4, and CXCR3, Perforin, Granzyme B and Interferon gamma (IFNg). Prior to FACS analysis for IFNg, cells were cultured for 4 hours with Brefeldin A. NK cells respond to external stimuli such as cytokines in their environment through the phosphorylation of proteins JAK/STAT, ERK, and p38/MAPK pathways which are important for cell activation, signaling and differentiation pathways. The phosphorylation of AKT, STAT3 and STAT5 in response to cytokine addition was measured by FACS. Since phosphorylation events are transient NK-92 cells were treated with the cytokines for 15 or 60 minutes, prior to the analysis. The fold change in mean fluorescence intensities compared to untreated are presented in Table 84.

Treatment with IL15 resulted in an increase in the expression of CD69, CXCR4, Perforin, Granzyme B, and IFNg. The effect of IL 15 on these markers was dose dependent with a higher dose of IL15 resulting in a corresponding upregulation of markers. Phosphorylation of STAT5 was increased both at 15 and 60 minutes after the addition of L2 or IL15. Taken together, these results show that cytokines can activate NK cells.

Figure 64:
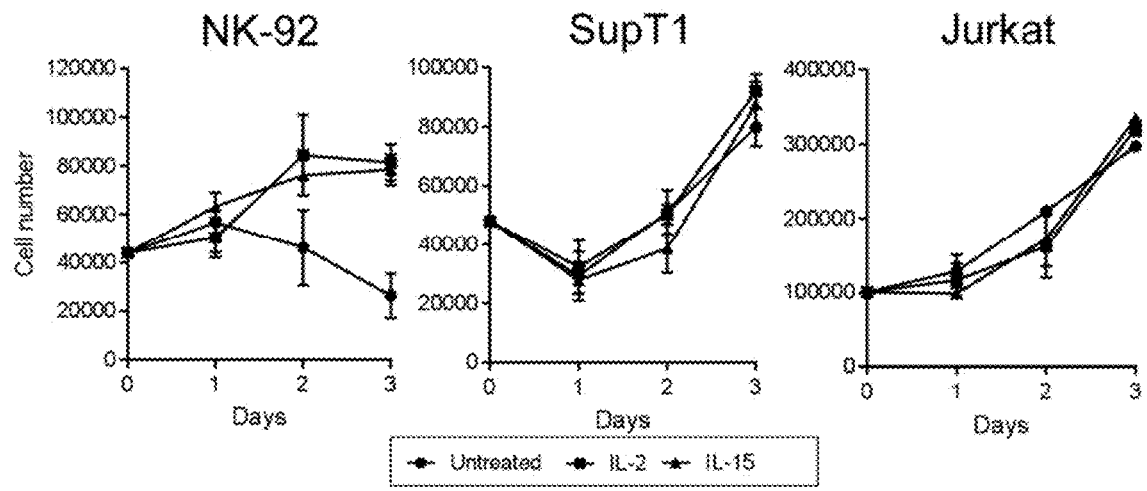
FIG. 64 represents the proliferation of cell lines in response to cytokines.

The dependency of immune cells on cytokines for proliferation was tested in NK-92 cells and T cell lines Jurkat cells and SupT1 cells. Cells were seeded at 40,000 per well and cultured in the presence of L2 or IL15 for 3 days. As shown in FIG. 64, the number of NK-92 cells decreased with time in the untreated cells. However, treatment with either L2 or IL15 increased cell numbers. In contrast, the cell numbers obtained with cytokine treatment in SupT1 and Jurkat cells was comparable to the untreated control. Thus, NK-92 cells depend on cytokines for survival.

Example 52. Effect of Cytokines on Immune Cell Proliferation and Activation

Immune cells such as Natural Killer cells depend on cytokines such as IL2 for their proliferation and survival. This dependence on cytokines can be used to test the functionality of DD regulated or constitutively expressed cytokines and cytokine fusion proteins.

The dependency of the NK-92 cells on cytokines for activation was tested. Cells were initially cultured for 3 days with IL2, following which cells were washed twice and cultured in media without L2 for 7 hours. The cells were cultured for 18 hours in the presence of IL2 (100 μg/ml). NK-92 cell activation in response to cytokine treatment was evaluated by FACS analysis of a panel of markers whose increased expression is associated with NK activation. These include NKG2D, CD71, CD69; chemokine receptors such as CCR5, CXCR4, and CXCR3, Perforin, Granzyme B and Interferon gamma (IFNg). Prior to FACS for IFNg, cells were cultured for 4 hours with Brefeldin A. IFNg levels were also measured in the media. NK cells respond to external stimuli such as cytokines in their environment through the phosphorylation of proteins JAK/STAT, ERK, and p38/MAPK pathways which are important for cell activation, signalling and differentiation pathways. The phosphorylation of AKT, STAT3 and STAT5 in response to cytokine addition was measured by FACS. Since phosphorylation events are transient NK-92 cells were treated with the cytokines for 15 or 60 minutes, prior to the analysis. The fold change in mean fluorescence intensities compared to untreated for IL2 treatment for select markers are presented in Table 85.

TABLE 84

NK cell activation markers

| IL15 dose (ng/ml) | CD69 | CXCR4 | Perforin | Granzyme B | pSTAT5 (15 mins) | pSTAT5 (60 mins) | IFNgamma |
|---|---|---|---|---|---|---|---|
| 100 | 1.91 | 3.87 | 1.67 | 1.48 | 1.98 | 2.34 | 9.00 |
| 20 | 2.10 | 3.62 | 1.57 | 1.40 | 1.96 | 2.35 | 5.55 |
| 4 | 1.59 | 3.03 | 1.28 | 1.16 | 1.81 | 2.35 | 2.76 |
| 0.8 | 1.18 | 2.10 | 1.16 | 1.09 | 1.76 | 2.17 | 1.92 |
| 0.16 | 0.99 | 1.41 | 1.04 | 1.03 | 1.44 | 2.08 | 2.41 |
| 0.032 | 1.05 | 1.14 | 0.92 | 0.92 | 1.23 | 1.67 | 0.95 |
| 0.0064 | 1.11 | 1.19 | 0.79 | 0.78 | 1.03 | 1.26 | 0.85 |
| 0.00128 | 1.07 | 1.15 | 0.85 | 0.88 | 0.99 | 1.04 | 1.19 |

TABLE 85

IL2-induced markers

| Marker | Fold change |
|---|---|
| CD69 | 1.60 |
| CXCR4 | 3.56 |
| Perforin | 1.72 |
| Granzyme | 1.62 |
| IFNg (cellular) | 1.15 |
| IFNg (Supernatant) | 7.43 |
| pAKT (15 mins) | 1.23 |
| pAKT (60 mins) | 1.34 |
| pSTAT3 (15 mins) | 1.19 |
| pSTAT3 (60 mins) | 1.38 |
| pSTAT5 (15 mins) | 1.90 |

Treatment with IL2 resulted in an increase in an increase in the expression of CD69, CXCR4, Perforin, Granzyme B, and IFNg. Further, IFNg levels secreted by NK-92 cells into the media higher than untreated controls upon treatment with IL2. Phosphorylation of STAT5 was increased both at 15 and 60 minutes after the addition of IL2. A modest increase in phospho AKT and STAT3 was observed. Taken together, these results show that cytokines can activate NK cells.

The dependency of immune cells on cytokines for proliferation was tested in NK-92 cells (natural killer cell line) and T cell lines Jurkat cells and SupT1 cells. Cells were seeded at 40,000 per well and cultured in the presence of IL2 or IL15 for 3 days. The number of NK-92 cells decreased with time in the untreated cells. However, treatment with IL2 increased cell numbers. In contrast, the cell numbers obtained with cytokine treatment in SupT1 and Jurkat cells was comparable to the untreated control. Thus, NK-92 cells depend on cytokines for survival.

Example 53. Effect of Cytokines on T Cell Expansion and Activation

Figure 37A:
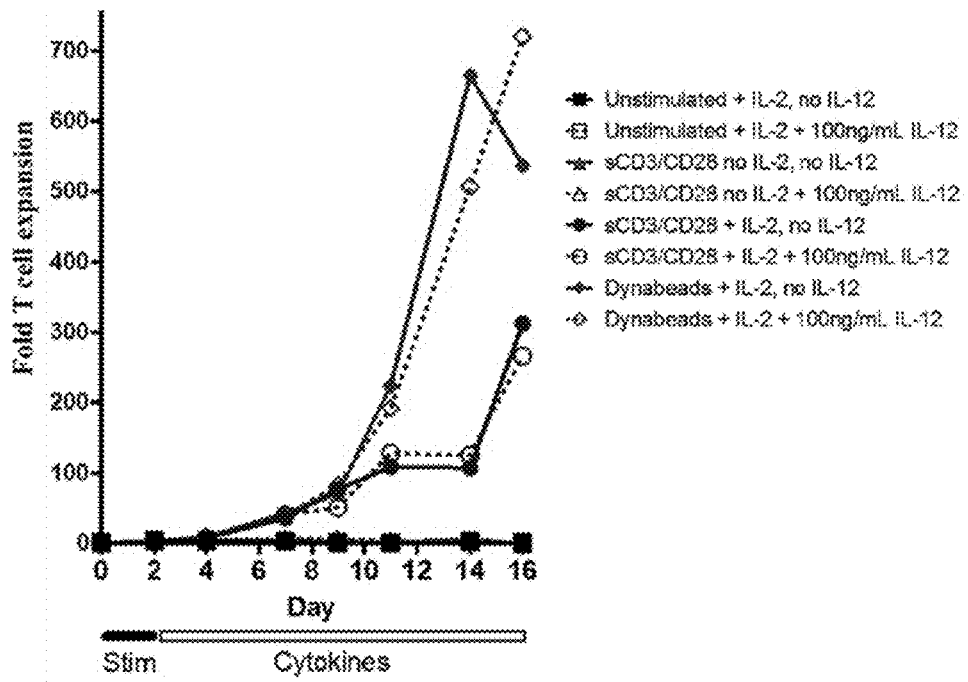
FIG. 37A-FIG. 37D show effect of cytokines on T cell expansion and activation.

To test the requirement of IL2 and IL12 for T cells expansion and activation, T cells were stimulated with soluble CD3/CD28, CD3/CD28 Dynabeads or left unstimulated for two days. Each of these groups was further split into two sub groups. One sub group was treated with IL2 and 100 ng/ml of IL12 while the second sub group was treated with L2 only for the duration of the stimulation. For the soluble CD3/CD28 stimulated cells, a third subgroup that was only treated with 100 ng/ml of IL12 was also included. T cell expansion over the course of 14 days was measured and the fold change in T cells expansion is shown in FIG. 37A. CD3/CD28 dynabeads plus L2 with or without IL12 had the most profound impact on T cell expansion followed by the T cells treated with soluble CD3/CD28 plus L2 with or without IL12. Unstimulated cells and cells treated with soluble CD3/CD28 cells that did receive IL2 treatment were unable to expand over the course of the experiment. These results show that L2 is required for T cell expansion, but IL12 may be dispensable.

Figure 37B:
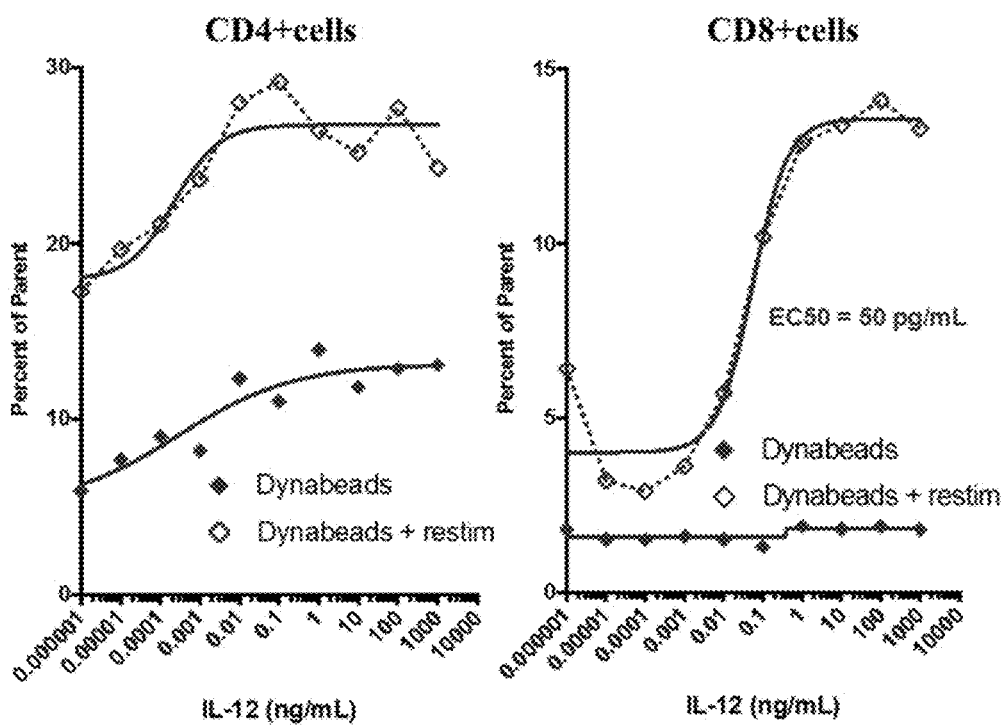
Figure 37C:
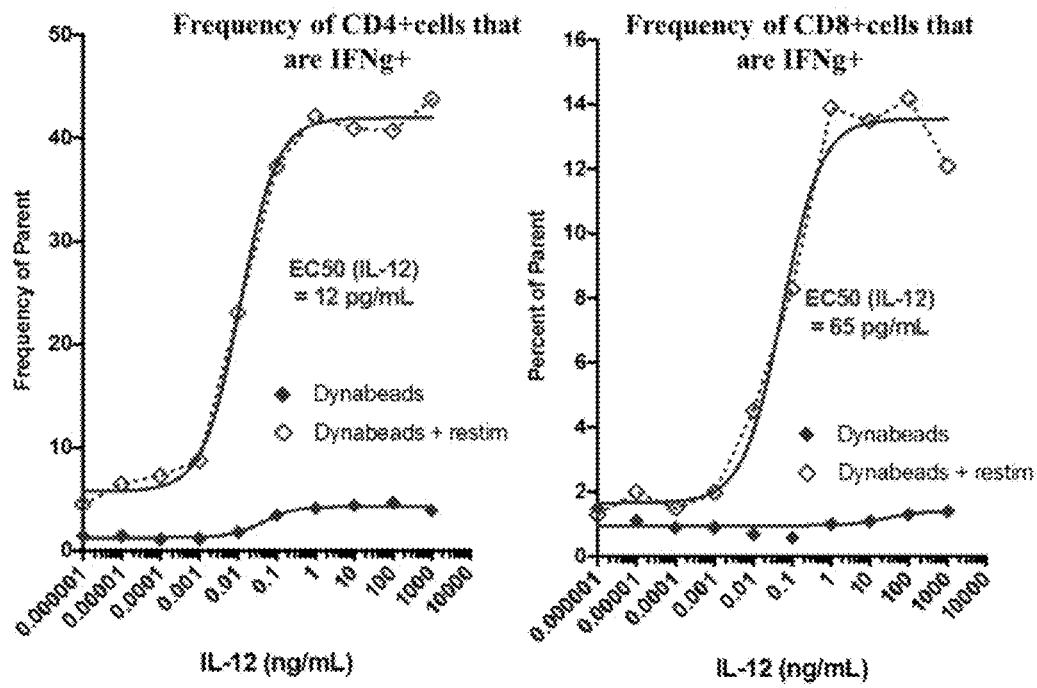

The effect of IL12 on T cell activation was measured by determining the frequency of IFNgamma positive CD4+ and CD8+ T cells. IFNg is produced by activated T cells. Three different stimulation protocols were used. In the first protocol, cells were stimulated with CD3/CD28 dynabeads for 2 days, following which the beads were washed off and the cells were treated with varying concentrations of IL12 for 7 days (from day 2 to day 9). At day 9, cells were restimulated with soluble CD3/CD28 and the frequency of IFNgamma positive cells was determined by FACS. The results are presented in FIG. 37B as the percentage of cells. In the second protocol, following 2 day CD3/CD28 dynabeads stimulation, T cells were maintained in culture for a longer duration of 14 days i.e. from day 2 to day 16. At day 16, cells were restimulated with soluble CD3/CD28. At day 16, the frequency of IFNgamma positive cells was measured. The results are presented in FIG. 37C as the percentage of cells. In the third protocol, T cells were initially stimulated for 2 days with CD3/CD28 dynabeads and IL2, followed by treatment with L2 only for 9 days (i.e. from day 2 to day 11), followed by IL12 treatment for 2 to 5 days. In the last two days of the experiment, cells were also restimulated with soluble CD3/CD28. IFNgamma positive CD4 and CD8 cells were measured using FACS. The third protocol mimics the environment that is presented to T cells in adoptive cell therapy, both during in vitro transduction and T cells expansion as well as the in vivo. The results are presented in FIG. 37D as the percentage of cells. In both 7-day treatment with IL12 as well as 14-day treatment with IL12, shown in FIG. 37B and FIG. 37C respectively, restimulation with CD3/CD28 cells at the end of the experiment increased the percentage of IFNgamma positive cells. A half maximum effective concentration (EC50) of IL12 observed with the first protocol for CD8 cells was 50 µg/ml. The EC50 of IL12 observed with the second protocol was 12 µg/ml for CD4 cells and 65 µg/ml for CD8 cells. Long-term culture with CD3/CD28 further increased the dependence on re-stimulation and IL12 for IFNg production.

Figure 37D:
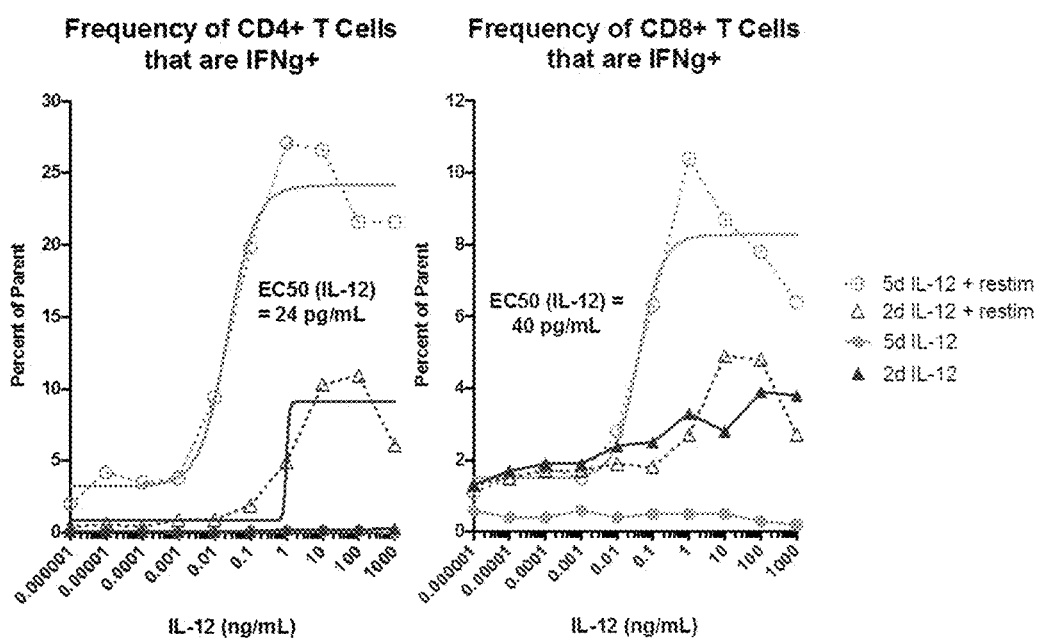

The results obtained with the third stimulation protocol are presented in FIG. 37D. Immune cells treated with IL12 for the final 5 days of the experiment combined with CD3/CD28 restimulation showed the highest percentage of IFN gamma positive cells (EC50=24 µg/ml for CD4 cells and 40 µg/ml for CD8 cells), followed by cells that received IL12 for 2 days. Thus, T cells expanded in vitro can later differentiate in response to IL12, but restimulation may be required for IFNg production.

Taken together these results indicate that IL12 can stimulate IFN production in T cells when restimulated with CD3/CD28.

Example 54. Promoter Selection for Expression of SREs in T Cells

Figure 38:
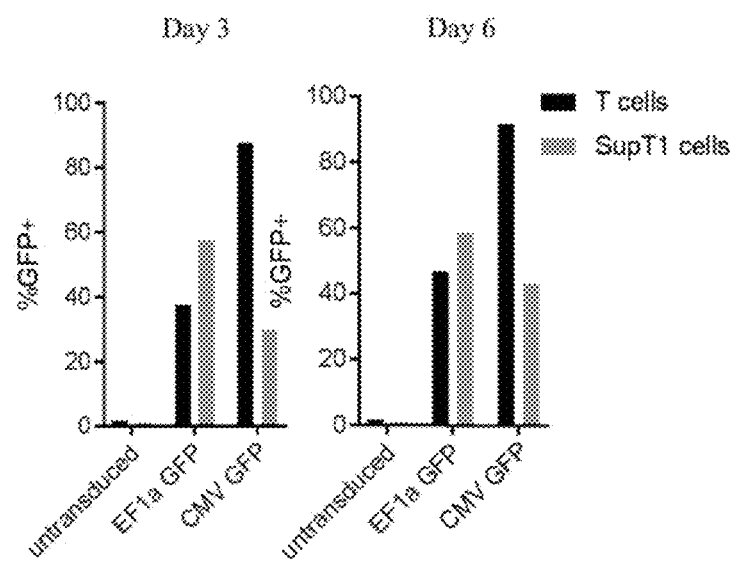
FIG. 38 is a bar graph representing the effect of promoters on transgene expression.

The expression of SREs expressed in a vector can be driven by either the retroviral long terminal repeat (LTR) or by cellular or viral promoters located upstream of the SRE. The activity of the promoter may vary with the cell type and thus promoter selection must be optimized for each cell type. To identify optimal promoters for T cells, AcGFP (SEQ ID NO. 3104) was cloned into pLVX. IRES Puro construct with a CMV or an EF1a promoter. Patient derived T cells and Sup T1 cells were transduced with the constructs and GFP expression was measured at day 3 and day 5 after transduction using FACS. As shown in FIG. 38, both the CMV promoter and the EF1a promoter can drive the expression of GFP in SupT1 cells and T cells. The percentage of GFP positive T cells was higher when the GFP expression was driven by CMV promoter compared to an EF1a promoter, both at 3 days and 6 days after transduction. In contrast, the percentage of GFP positive Sup T1 cells was much higher when GFP expression was driven by the EF1a promoter when compared to the CMV promoter. Thus, the optimum promoter suitable for expression differs based on the cell type.

Example 55. Effect of Ligand on T Cell Proliferation

The effect of ligands specific to the SREs of the invention on immune cell proliferation was measured to identify concentrations of the ligand that did not inhibit T cell growth or survival. T cells derived from two different donors were stimulated with CD3/CD28 and treated with ligand TMP at doses ranging from 0.04 µM to 160 µM or with control vehicle (DMSO). The percentage of divided cells within the CD4 and the CD8 populations of T cells was measured using FACS. Concentrations of TMP ranging from 0.04 µM to 40 µM showed no effect on the percentage of divided cells within the CD8 and CD4 populations, while 160 µM concentration of TMP resulted in an 70-90% reduction in the percentage of divided cells. Thus, the optimal concentration of TMP for T cell based experiments was determined to be less than 160 µM.

Example 56. Effect of DD Regulated CD19 CAR on Tonic Signaling

Chronic antigen activation can result in T cell exhaustion. To test if DD regulated CD19 CAR constructs induce tonic signaling, irradiated K562 cells expressing CD19 are plated into culture plates 12 hours before the addition of T cells expressing DD regulated CD19 CAR constructs with Interleukin 2. Cells are counted every two days and media is replaced. For repeated stimulations, cells are transferred to a new plate with K562-CD19 cells after 24 hours (for two stimulations) or every 12 hours (for four stimulations). For each condition, T cells are counted and analyzed by FACS for CAR, phenotypic and exhaustion markers every 12 hours. DD regulated constructs were analyzed in the presence or absence of ligand. Markers analyzed include CD25 and CD69 for activation status; CD62 and CD45RA for memory status; and exhaustion markers PD1, TIM3 and LAG3. DD regulated CD19 CAR constructs are expected to induce a lower percentage of cells that are positive for all three exhaustion markers—i.e. PD1, TIM3 and LAG3 and a higher percentage of cells that are CD45A+/CD62L+ indicating less differentiated T cells. Constitutively expressed CD19CAR constructs may induce the expression of all three exhaustion markers and may have a more differentiated phenotype with a higher proportion of CD45−/CD62L− and CD45+/CD62L−cells.

Example 57. Functional Analysis of DD Regulated CD19 CAR

To test the ability of DD regulated CD19 CAR cells to kill target cells, primary T cell populations transduced with DD regulated CD19 CAR constructs are co cultured with K562 cells expressing CD19 (target cells) at a ratio of 5:1 in the presence or absence of the ligand specific to the DD e.g. Shield-1, TMP or MTX. Additional control combinations of T cells and target cells are also set up. These include DD regulated CAR expressing T cells co cultured with K562 cells (in the presence or absence of the ligand), T cells co cultured with K562 cells expressing CD19 and K562 cells expressing CD19 without T cell co culture. The K562 cells are fluorescently labelled with NucLight Red and co cultured with T cells for 30 hours. Cell death is monitored by labelling cells with Annexin V and the cell death in target K562 cells is monitored by evaluating cells that are positive for both Annexin V and NucLight Red. The ratio of Annexin V staining per target cell area is calculated. DD-CD19CAR expressing T cells are expected to be effective in killing target K562 cells expressing CD19 only in the presence of the ligand specific to the DD. Minimal target cell death is expected to occur when untransduced T cells are cocultured with CD19 expressing target cells; and with DD-CAR T cells (with or without ligand treatment) plus K562 cells (without CD19 expression).

Example 58. Generation of CD19 scFvs Using the Large Phage Antibody Libraries Construction of Primary Phagemid Library Total RNA is prepared from 40 different samples of human peripheral blood lymphocytes and cDNA is synthesized using random primers. IgM variable regions are amplified using an IgM 3' primer and 5'VH primers. Pooled primers are also used to amplify the Vk and VL. An additional PCR step is added to include restriction sites as well as to introduce a region of overlap containing an scFv loxP linker. scFvs are obtained by mixing equimolar amounts of VH and VL genes and performing assembly. The scFvs are then cloned into pDAN5 vectors to obtain a primary library of approximately $10^8$.

Recombination and Secondary of the Secondary Library

To induce recombination, bacterial strain BS1365 (which express Cre-recombinases constitutively) are infected with primary phagemid library at an MOI of 20:1. This results in bacteria containing multiple phagemids, each of which encodes different VH and VL genes, which can be recombined by the Cre recombinase. Since the phagemid arise from bacteria containing many different scFv, the phenotype and genotype are not coupled. Phagemids derived from the bacteria are used to infect bacteria that do not express Cre (e.g. DH5a) at a low MOI of ≤0.1 to couple genotype to phenotype.

CD9 Expression Constructs and Cell Lines

Human CD19 isoforms described in Table 42 are cloned into appropriate vectors and transfected into cell lines with low endogenous CD19 expression such as K562 and 3T3 cell lines. The CD19 expressing lines i.e. K562-CD19 or 3T3-CD19 cells, are used for positive selection of scFvs in the phage display library. The parental K562 and 3T3 are used for the negative selection.

Selection of Antibodies Recognizing CD19 on Cell Surface

The secondary phage display library is pre-cleared by screening with parental cells to remove non-specific binding phages. The precleared phages are incubated with K562-CD19 or 3T3-CD19 cells, and bound phages are recovered and amplified for next round of selection. Three rounds of selection are performed to enrich for CD19 binders. FMC63-distinct scFvs i.e. scFvs that bind to epitopes distinct from FMC63, are selected in a parallel selection process by blocking the FMC63 epitope with an excess of FMC63 antibody.

The affinity of the scFv to CD19 is a critical aspect that determines the performance of the antibody in pharmacokinetic and immune response assays. Affinity measurements for 96 scFv clones are made using techniques such as ELISA and surface plasma resonance which provide on-rate (Ka), off-rate (Kd), and affinity constant (KD).

scFv clones with desired off rates are subjected to Sanger sequencing to identify unique clones that bind to CD19 expressing cells but not parental cells. Identified clones are then subject to epitope binning, using a competitive immunoassay that is used to characterize and then sort a library of scFvs against a target protein, e.g. CD19. scFvs against CD19 are tested against all other CD19 scFvs identified from the library, in a pairwise fashion to identify scFvs that prevent the binding of other scFvs to an epitope of CD19 antigen. After a profile is created for each CD19 scFv, a competitive blocking profile is created for each scFv relative to the others. Closely related binning profiles indicate that the antibodies have the same or a closely related epitope are binned together.

scFvs obtained at each of step of the selection process are subject to deep sequencing methods such as Ion Torrent/ MiSeq. Heavy chain CDR3 sequences, including those that do not bind to FMC63 are identified using the Abmining ToolBox (D'Angelo S et al. (2014) MAbs. 6(1): 160-172) and top ranking HCDR3s are identified. HCDR3 specific primers designed from the DNA sequence of the top ranked sequences are then used to amplify scFv clones by inverse PCR and the PCR product is cloned into expression vectors.

Example 59. CD19 scFv Affinity

The affinity of the scFv to the CD19 antigen is a critical aspect that determines the performance of the antibody in pharmacokinetic and immune response assays. Affinity measurements are made using techniques such as ELISA and surface plasma resonance which provide on-rate (Ka), off-rate (Kd), and affinity constant (KD).

Antibodies with varying affinities are identified using cells that have high or low ectopic expression of CD19. K562-CD19 cells and parental K562 cells with low CD19 expression are sorted by FACS using CD19 antibodies e.g. FMC63 to determine surface expression of CD19. Cells are sorted into bottom 5% (i.e. low CD19 expressing cells), top 5% (high CD19 expressing cells) and the rest of the population of cells is categorized as median CD19 expressing cells.

Example 60. Screening Strategy for Identifying FMC63-Distinct CD19 scFvs

CD19/Fc Fusion Proteins

FMC63 binds to human CD19 in the region encoded by exon 2. To identify FMC63-distinct CD19 scFvs, human CD19 (Exon 1-4) or human CD19 (Exon 1,3,4) are fused with IgG to generate CD19-IgG fusion proteins, CD19sIgG1-4 and CD19sIgG1,3,4 respectively. CD19-IgG fusion proteins are used for antibody screening. 96-well plates are coated with capture antibodies and incubated with CD19sIgG1-4 or CD19sIgG1,3,4 fusion protein. The plates are washed and incubated with candidate CD19 scFvs identified in Example 28. The plates are washed again and incubated again with reporter (e.g. Alkaline phosphatase) conjugated detection antibodies and detected using reporter compatible detection methods. Capture antibodies may be antihuman IgG Fc antibodies, or the FMC63 antibody (as a control). The detection antibody may be anti-human IgM antibody. FMC63-distinct CD19 scFvs are expected to bind to (CD19sIgG1,3,4) and (CD19sIgG1-4). In contrast, candidate CD19 scFvs that bind to epitopes that are identical or overlap with FMC63's epitope are expected to only bind to (CD19sIgG1-4).

Competition Assay

CD19 expressing K562 cells are incubated with nano molar concentrations of tagged candidate CD19 scFvs e.g. identified in Example 28 and fixed concentration of tagged FMC63 scFv for competition binding assays. Cells are washed and stained with the secondary antibody corresponding to the tag used in the candidate CD19 scFv. Mean fluorescence intensity is measured using flow cytometry. As a negative control, CD19 K562 expressing cells are incubated with varying concentrations of tagged candidate CD19 scFv alone or FMC63 alone. For FMC63-distinct CD19 scFvs, it is expected that there will be no competition for binding to CD19 between the candidate CD19 scFvs and FMC63. Thus, the mean fluorescence intensity of the tagged candidate CD19 scFv is expected to increase with increasing concentrations of the candidate CD19 scFv, while the mean fluorescence intensity of tagged FMC63 antibody is not expected to decrease with increasing concentrations of the candidate CD19 scFv. This would indicate that the FMC63 is not displaced from its epitope by the addition of the candidate CD19 scFv, suggesting distinct binding epitopes. For candidate CD19 scFv that bind to the same epitope as FMC63, a decrease in the fluorescence intensity of FMC63 with increasing concentrations of the candidate CD19 scFv is expected.

Example 61. Functional Analysis of FMC63-Distinct CD19 CAR Constructs

FMC63-distinct CD19 scFvs engineered to generate FMC63-distinct CD19 CAR constructs with destabilizing domains, linkers, transmembrane and intracellular domains described in Table 1, and Tables 14-17. The ability of FMC63-distinct CD19 CAR to induce cell activation, cytotoxicity and proliferation is compared to the FMC63-CD19 based CAR constructs in Jurkat cells. Constructs are also analyzed for their ability to induce the upregulation of exhaustion markers, PD1, TIM3 and LAG3, and constructs that are positive for multiple exhaustion markers are excluded from the analysis. Constructs that can induce Jurkat cell activation and cytotoxicity but not exhaustion markers are transduced into T cells and their efficacy is compared with the constitutively expressed FMC63-based CD19 CAR construct. It is expected that DD regulated FMC63-distinct CD19 CAR constructs will demonstrate superior cytotoxic capabilities with minimal tonic signaling as compared to FMC63 CD19 CAR constructs.

Example 62. Ligand Dependent Target Cell Death Induced by DD Regulated CD19 CAR

Figure 39A:
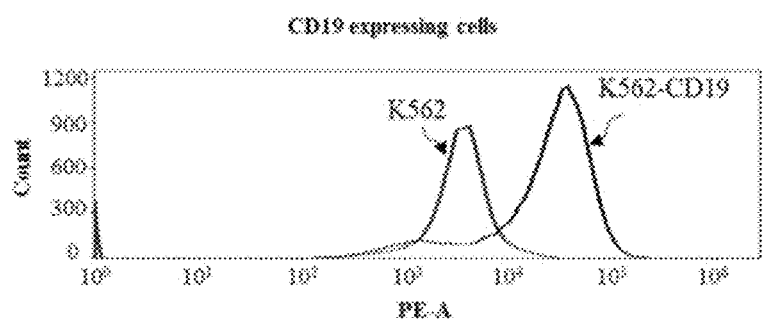
FIG. 39A-FIG. 39C shows results of assays for ligand dependent target cell death induced by DD regulated CD19 CAR.

To test the antigen specificity of cell killing by T cells engineered to express constitutive or DD-containing CAR construct, CD19 was ectopically expressed in the antigen negative K562 cell line. CD19 expression was measured using anti-CD19 antibody conjugated to Phycoerythrin (PE). FIG. 39A shows the expression of CD19 in parental K562 cells and K562-CD19 cells, wherein CD19 is ectopically expressed.

Figure 39B:
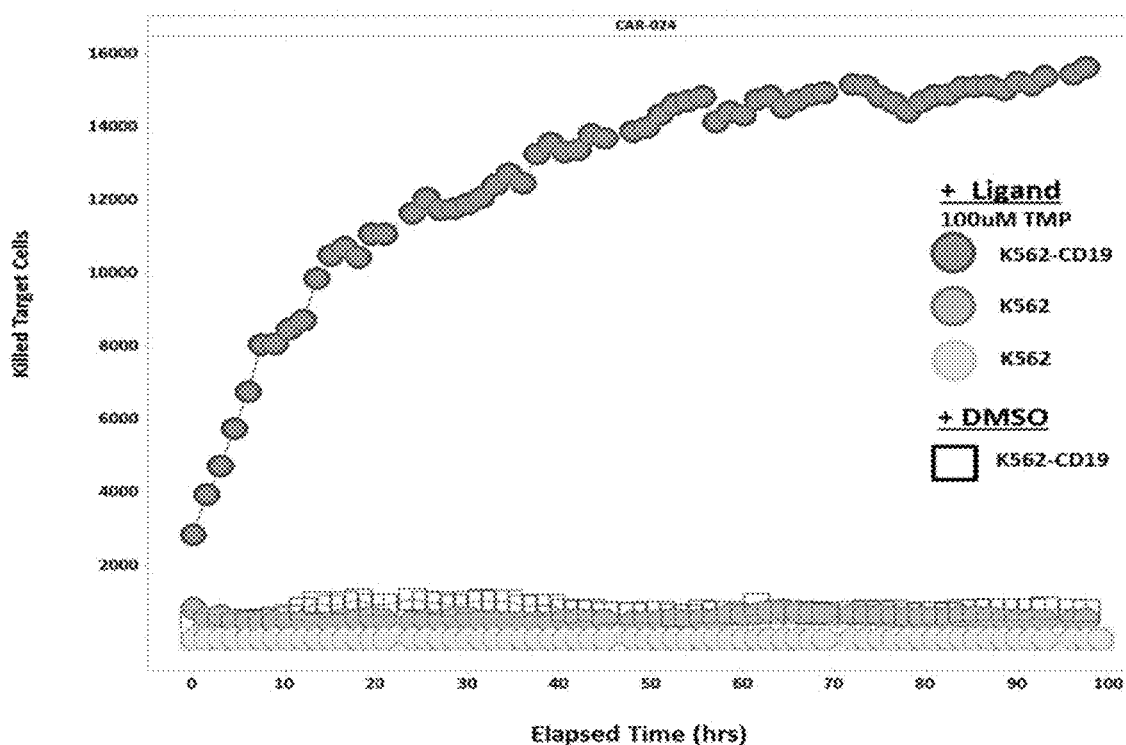
Figure 39C:
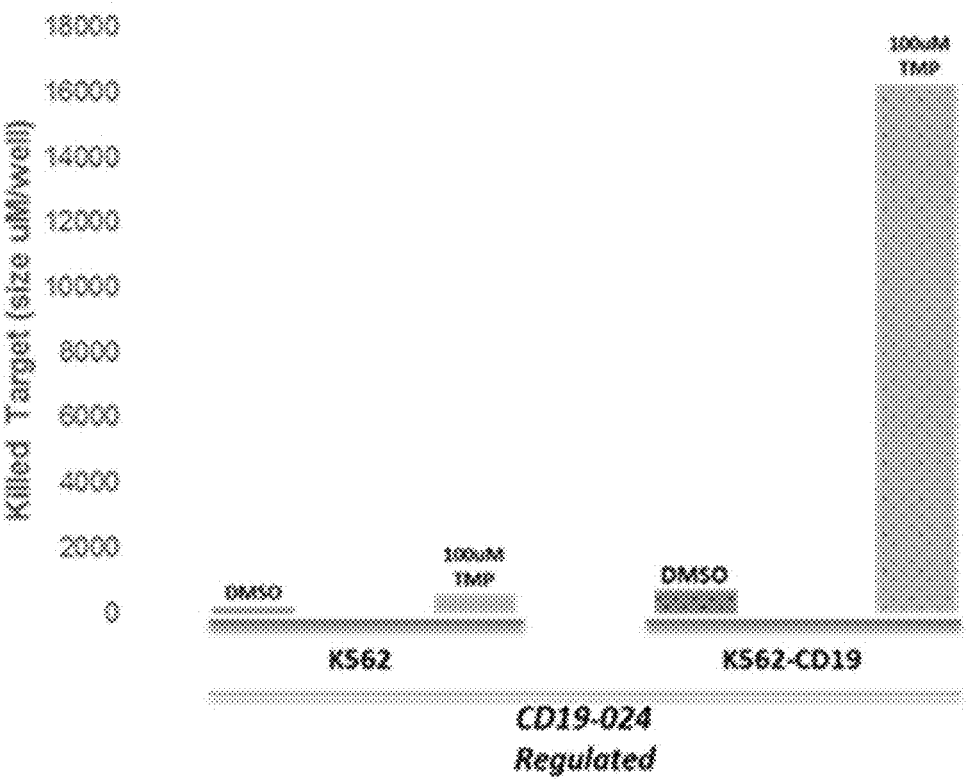

To test the ability of DD regulated CD19 CAR cells to kill target cells, primary T cell populations were transduced with DD regulated CD19 CAR constructs, OT-CD19-024 with human DHFR DD and an EF1a promoter. Transduced T cells were co cultured with K562 cells expressing CD19 (target cells) at a ratio of 5:1 in the presence or absence of TMP (100 µM). Additional control combinations of T cells and target cells were also set up. These included DD regulated CAR expressing T cells co cultured with antigen-negative K562 cells (in the presence or absence of the ligand), untransduced T cells co cultured with K562 cells expressing CD19 and K562 cells expressing CD19 without T cell co culture. The T cells utilized for this experiment were transduced with the OT-CD19-024 construct (or untransduced) and expanded for 11 days using protocols described in previous examples, frozen, thawed and co-cultured with target cells. Target cells were treated with Mitomycin C to prevent their proliferation. The K562 or K562-CD19 target cells stably expressing the fluorescent protein NucLight Red were co cultured with T cells for 300 hours. Cell death was monitored by labelling cells with Annexin V and the cell death in target K562 and K562-CD19 cells was monitored by evaluating cells that were positive for both Annexin V and NucLight Red using the IncuCyte® Live Cell Analysis System (Essen Biosciences, Ann Arbor, Mich.). The results are presented in FIG. 39B, where the killed target cells represented on the y axis are based on target cells that are positive for both NucLight Red and Annexin V. FIG. 39C, shows the killed target size as measured in (µM/well) at day 5. Target cell killing was observed with the OT-CD19-024 construct only in TMP treated co-cultures of T cells and K562 target cells ectopically expressing CD19. No cell killing was observed in untreated controls of the same co-culture set up and when T cells were co cultured with parental K562 cells that do not express CD19 in the presence or absence of ligand. These data show that regulated CARs display ligand- and target-dependent cell killing with minimal basal off-state.

Example 63. In Vitro CAR-T Cell Functional Analysis

The efficacy of T cells expressing DD regulated CD19 CAR constructs in functionally interacting with target cells is evaluated. To interact with the CD19CAR T cells, the chosen target cells express CD19 naturally or ectopically. In this context, target cells which have high endogenous expression of CD19 such as Nalm6, Raji, Reh, Sem, Kopn8, and Daudi cells. Alternatively, target cell lines may be engineered by ectopic expression of CD19 in cell lines that have low endogenous expression of CD19 such as K562. Multiple assays are used to measure functionality. Prior to co culture, the target cells are optionally cultured in the presence of presence of mitomycin C to prevent target cell proliferation. This ensures that target cell growth does not out compete T cell growth. Cytotoxicity assays are used to measure the ability of T cells induce target cell death. Target cells are engineered to express *Renilla* or Firefly luciferase and co cultured with T cells expressing DD regulated CD19 CAR constructs for 18 to 24 hours in the presence of the ligand related to the DD or vehicle control. At the end of co culture, cells are lysed and luciferase activity is measured using appropriate substrate. Luciferase activity is expected to increase when DD regulated CD19 CAR expressing T cells are co cultured with CD19 expressing target cells in the presence of ligand. Cytotoxicity is not expected in vehicle control cells or when the target cells do not express CD19 are utilized.

Engagement of the CD19 CAR with CD19 antigen results in the activation of T cells which is measured 24 hours after co culture of CAR expressing T cells and target cells. Activation of T cells is evaluated by measuring levels of IFNg, IL2, and CD69. T cell proliferation in response to antigen mediated T cell activation is measured by labelling T cells with Carboxyfluorescein succinimidyl ester, which is used to trace cells across multiple generations. Labelled T cells are cultured with Mitomycin treated target cells and cell proliferation is tracked over a period of 3 to 5 days. T cell proliferation and activation is expected to increase when DD regulated CD19 CAR expressing T cells are co cultured with CD19 expressing target cells in the presence of ligand. Both parameters are not expected in vehicle control cells or when the target cells do not express CD19 are utilized.

Activation of T cells results in degranulation, an exocytic process by which cytotoxic T cells release molecules like perforin and granzymes which enable target cell killing. Degranulation is measured by analysis of media for indications of exocytosis e.g. CD107 by FACS and by markers of degranulation such as perforin and granzyme using immunoassays.

Example 64. Ligand Dependent Target Cell Death Induced by DD Regulated CD19 CAR

To test the ability of DD regulated CD19 CAR cells to kill target cells, primary T cell populations are transduced with DD regulated CD19 CAR constructs are co cultured with K562 cells expressing CD19 (target cells) at a ratio of 5:1 in the presence or absence of the ligand specific to the DD e.g. Shield-1 (1 µM), TMP (100 µM) or MTX. Constructs with FKBP, ecDHFR or human DHFR DDs may be utilized. Constructs with either CMV, EF1a or PGK promoters may also be used. Multiple combinations of T cells and target cells are set up. These included DD regulated CAR expressing T cells co cultured with K562 cells (in the presence or absence of the ligand), T cells co cultured with K562 cells expressing CD19 and K562 cells expressing CD19 without T cell co culture. Additional controls include target cells only; untransduced T cells; T cells transduced with empty vector. The T cells utilized for this experiment are expanded for 11 days using protocols described in previous examples, frozen, thawed and transduced with the CD19 CAR constructs. Target cells are treated with Mitomycin C to prevent their proliferation. The K562 cells are fluorescently labelled with NucLight Red and co cultured with T cells for 300 hours. Cell death is monitored by labelling cells with Annexin V and the cell death in target K562 cells is monitored by evaluating cells that are positive for both Annexin V and NucLight Red using the IncuCyte® Live Cell Analysis System (Essen Biosciences, Ann Arbor, Mich.). Target cell killing is expected with the DD regulated CAR constructs only in the presence of ligand and when K562 target cells ectopically expressing CD19 are utilized. No cell killing is expected in untreated controls of the same co-culture set up and when T cells are co cultured with parental K562 cells that do not express CD19 in the presence or absence of ligand. Constitutive constructs are predicted to show cell killing both in the presence of ligand. Cell killing is also not expected in cocultures with untransduced T cells, T cells transduced with empty vector; and cultures of target cells only.

Example 65. Effect of Ligand on Cytokine Expression

Figure 40A:
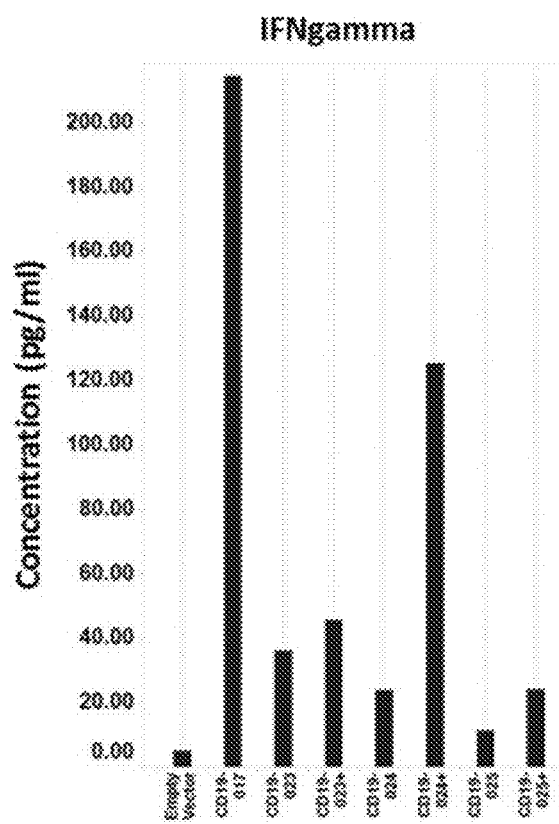
FIG. 40A-FIG. 40B show effects of ligands on expression of cytokines in T cells transduced with regulated CD19 CAR constructs.
Figure 40B:
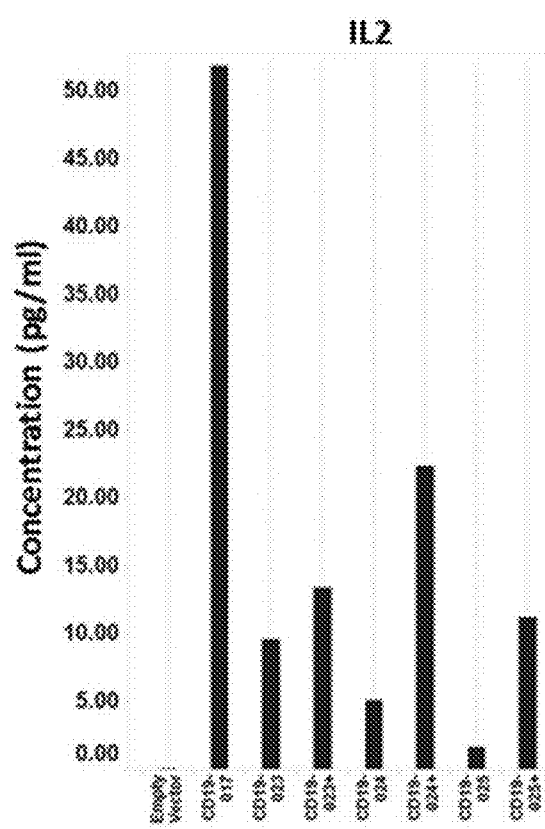

To study the effect of ligand on the expression of cytokines in regulated CD19 CAR constructs, T cell populations were transduced with empty vector, OT-CD19-017, OT-CD19-023, OT-CD19-024, or OT-CD19-025. $5 \times 10^4$ transduced T cells were co cultured for 48 hours at an E:T (effector to target cell) ratio of 5:1 in the presence or absence of TMP or Shield-1. Target cells were treated with 50 ug/ml of Mitomycin C to prevent their proliferation. The cytokine concentration of IFNγ and IL2 in the media supernatant were determined for each construct using MSD V-PLEX Proinflammatory Panel 1 Human Kit. The readout was obtained using a MESO QuickPlex SQ120. As shown in FIG. 40A, a 6 fold increase in IFNγ concentration was seen with the addition of ligand for OT-CD19-024, and a 2 fold increase in IFNγ concentration was seen with the addition of ligand for OT-CD19-025. As shown in FIG. 40B, a 6 fold increase in IL2 was seen for OT-CD19-024 with the addition of ligand and a 9 fold increase was seen for OT-CD19-025 with TMP.

Example 66. In Vivo Time Course Study of IL12 Levels in Mice

HCT116 parental cells or cells transduced with IL12 constructs (OT-IL12-020, OT-IL12-026, or OT-IL12-029) were injected into immune compromised CD1 nude mice (n=4 per group) according to the study design in Table 86 below.

TABLE 86

Study Design

| HCT116 cells | Day 15 Dose | Concentration | Route of Day 15 Dose |
|---|---|---|---|
| OT-IL12-026 | Vehicle | n/a | Intraperitoneal |
|  | Shield-1 (1x) | 10 mg/kg | Intraperitoneal |
|  | Shield-1 (3x, 2 h apart) | 10 mg/kg | Intraperitoneal |
| OT-IL12-029 | Vehicle | n/a | Intraperitoneal |
|  | Shield-1 (1x) | 10 mg/kg | Intraperitoneal |
|  | Shield-1 (3x, 2 h apart) | 10 mg/kg | Intraperitoneal |
| OT-IL12-020 | Vehicle | n/a | Intraperitoneal |
|  | Shield-1 (1x) | 10 mg/kg | Intraperitoneal |
| Parental | Vehicle | n/a | Intraperitoneal |
|  | Shield-1 (1x) | 10 mg/kg | Intraperitoneal |

The mice were bled (blood harvested for plasma PK and IL12 MSD) at day 14 after subcutaneous injection of $5 \times 10^6$ cells (day 0), and 6, 10, and 24 hours post the day 15 dosing. At the end of the study, tumor and kidneys were minced with the razor in 500 ul PBS, spun down, and supernatant isolated for IL12 Meso Scale Diagnostic (MSD) assay.

Figure 41A:
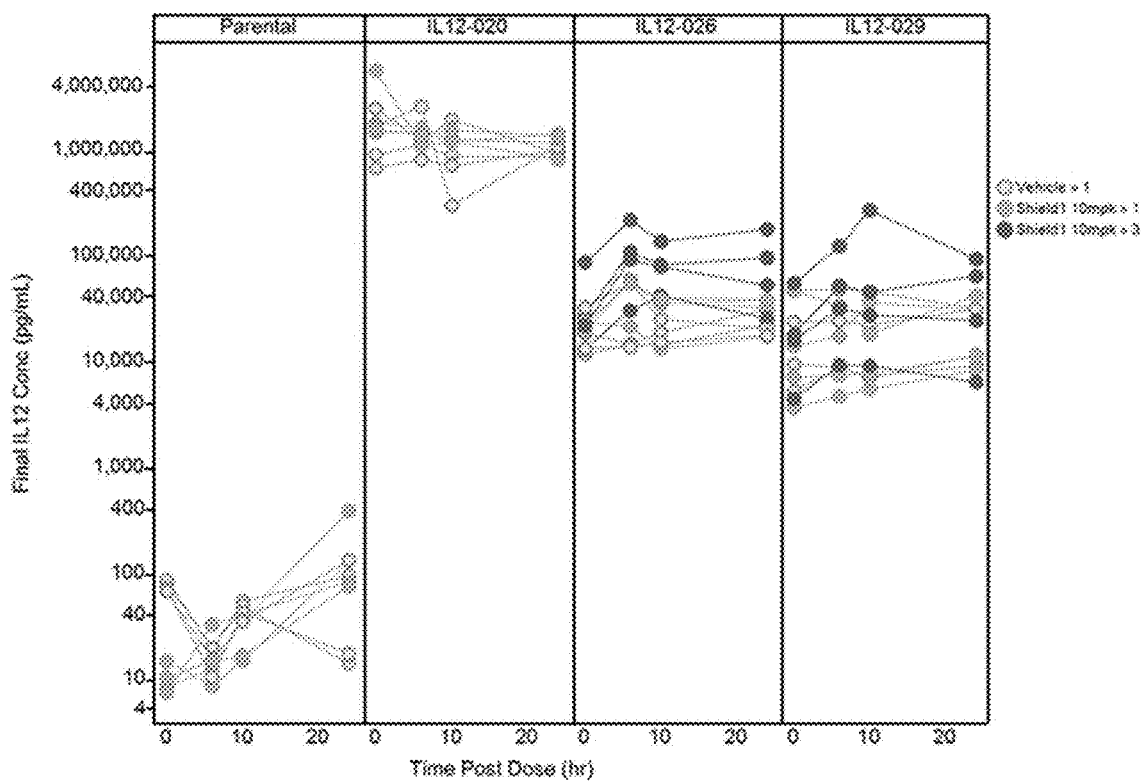
FIG. 41A-FIG. 41C show analyses of IL12 levels in vivo for mice injected with HCT116 parental cells or cells transduced with IL12 constructs.
Figure 41B:
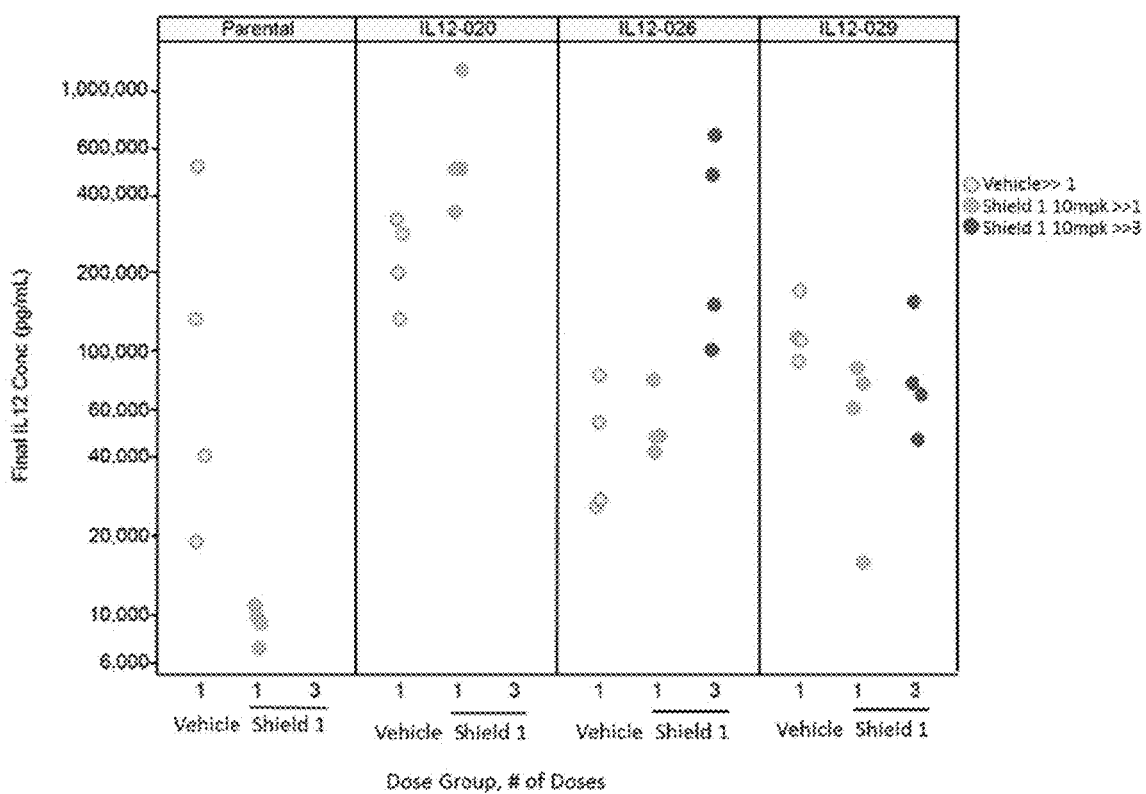
Figure 41C:
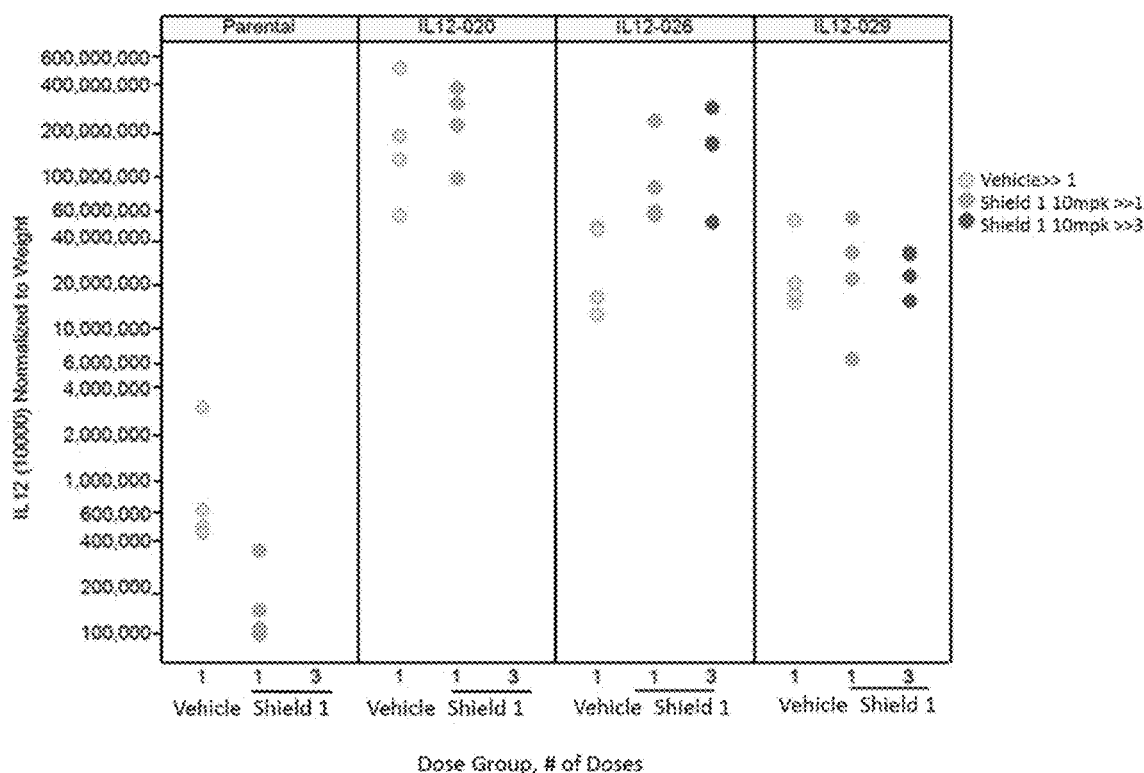

As shown in FIG. 41A, the basal plasma IL12 levels of the DD constructs were high, but the OT-IL12-026 and OT-IL12-029 constructs were still 100-fold lower than the constitutive (OT-IL12-020) construct. When FIG. 41A is shown as fold change from pre-dose plasma, OT-IL12-026 shows regulation at 6 and 10 hours. FIG. 41B and FIG. 41C show that IL12 is detectable in kidney (FIG. 41B) and tumor (FIG. 41C) and the levels coordinate with plasma levels.

Example 67. In Vivo Time Course Study of IL12 Levels in Mice

HCT116 parental cells or cells transduced with IL12 constructs (OT-IL12-020, OT-IL12-026) were injected subcutaneously into Matrigel plus in female NSG mice (implant 200 ul matrigel plug with $1 \times 10^7$ cells) (n=4) according to the study design in Table 87 below.

TABLE 87

Study Design

| HCT116 cells | Dose | Harvest Plug | Coverage above EC50 |
|---|---|---|---|
| OT-IL12-026 | Vehicle (1x) | 8 hours after $1^{st}$ dose | — |
|  | Vehicle (1x) | 24 hours after $1^{st}$ dose | — |
|  | AquaShield-100 mg/kg (1x) | 8 hours after $1^{st}$ dose | 4 hours |
|  | AquaShield-100 mg/kg (2x, 4 hours between doses) | 8 hours after $1^{st}$ dose | 8 hours |
|  | AquaShield-100 mg/kg (1x) | 24 hours after $1^{st}$ dose | 4 hours |
|  | AquaShield-100 mg/kg (2x, 4 hours between doses) | 24 hours after $1^{st}$ dose | 8 hours |
|  | AquaShield-100 mg/kg (3x, 4 hours between doses) | 24 hours after $1^{st}$ dose | 12 hours |
| OT-IL12-020 | Vehicle (1x) | 24 hours after $1^{st}$ dose | — |
| Parental | Vehicle (1x) | 24 hours after $1^{st}$ dose | — |

Figure 42A:
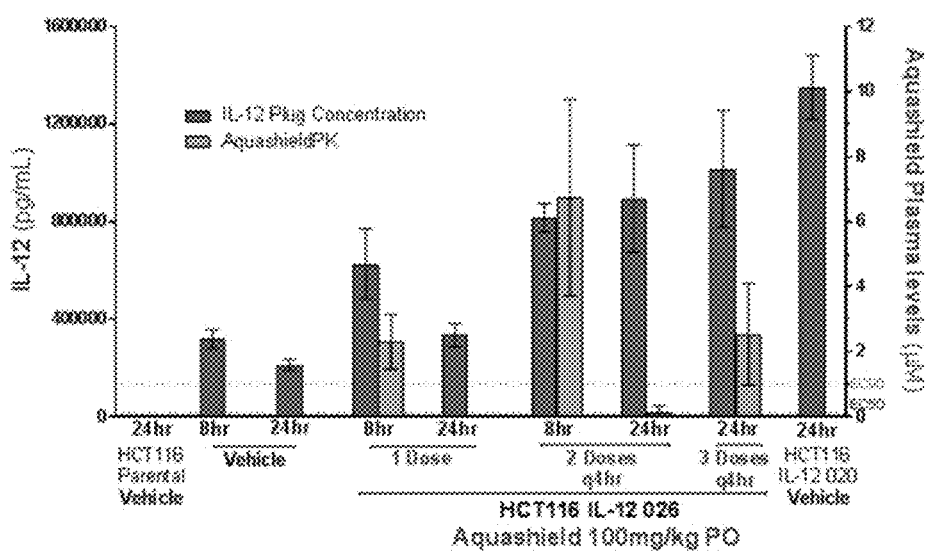
FIG. 42A-FIG. 42C show analyses of IL12 levels in vivo for mice injected subcutaneously with HCT116 parental cells or cells transduced with IL12 constructs and treated with vehicle or Aquashield.
Figure 42B:
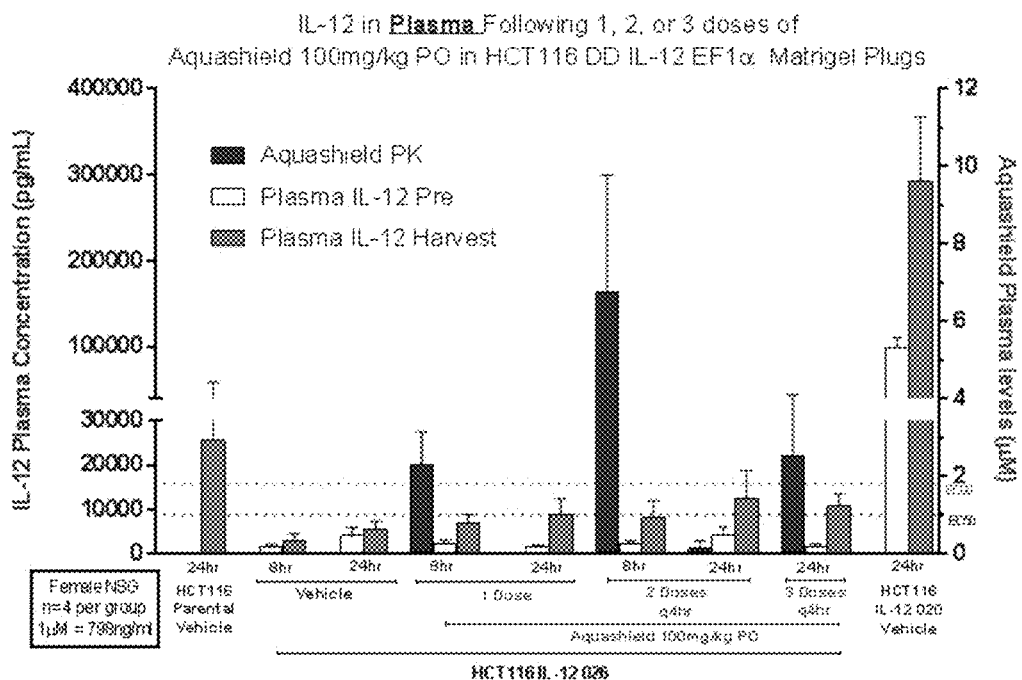
Figure 42C:
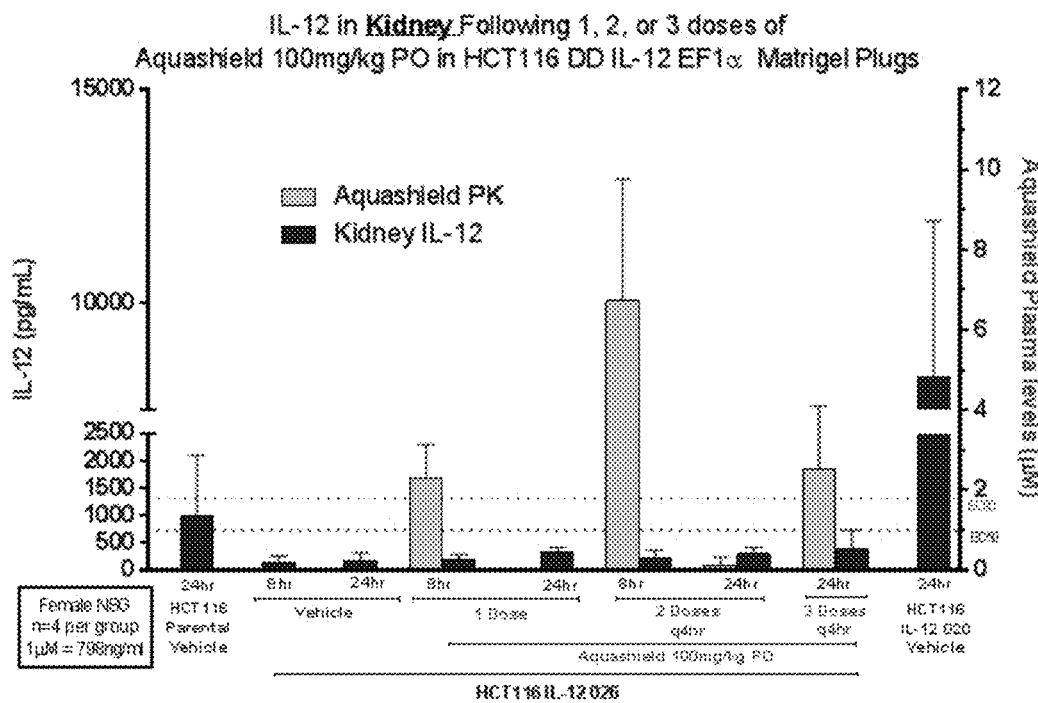

Terminal collection of plasma (for IL12 MSD), plug supernatants and kidneys were collected. As shown in FIG. 42A, regulation of IL12 was achieved in vivo with high dose Aquashield. There was less regulation observed in the plasma (FIG. 42B) and there was some flexi-IL12 detected in the kidneys (FIG. 42C).

Figure 43A:
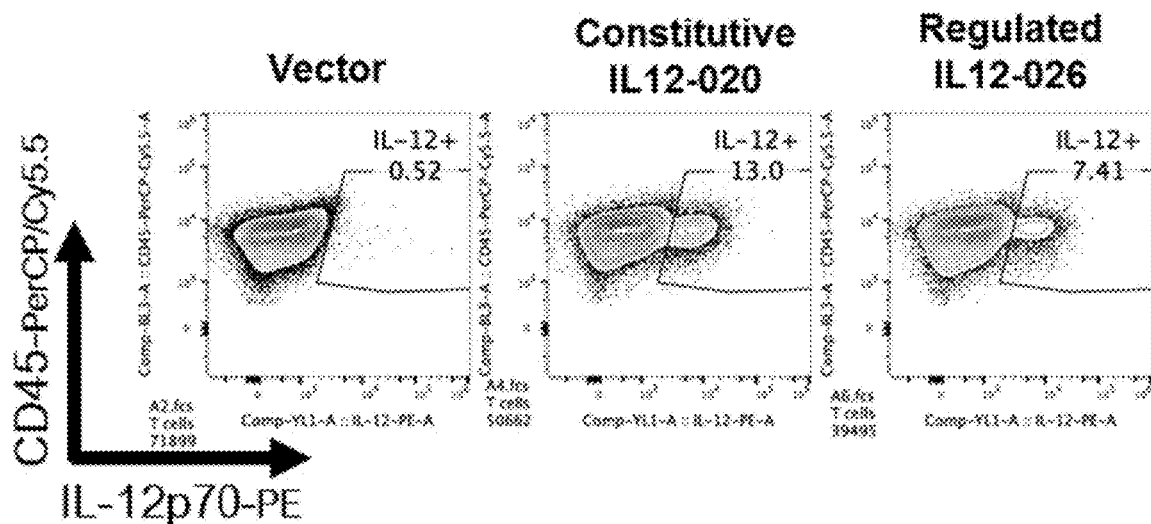
FIG. 43A-FIG. 43C show IL12 production by primary human T cells with regulated IL12 construct.
Figure 43B:
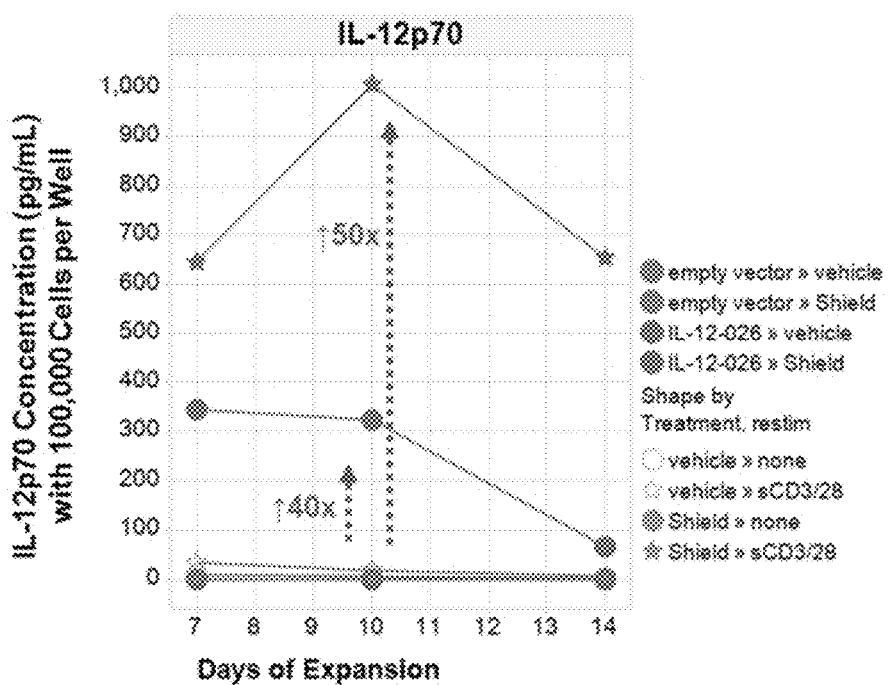
Figure 43C:
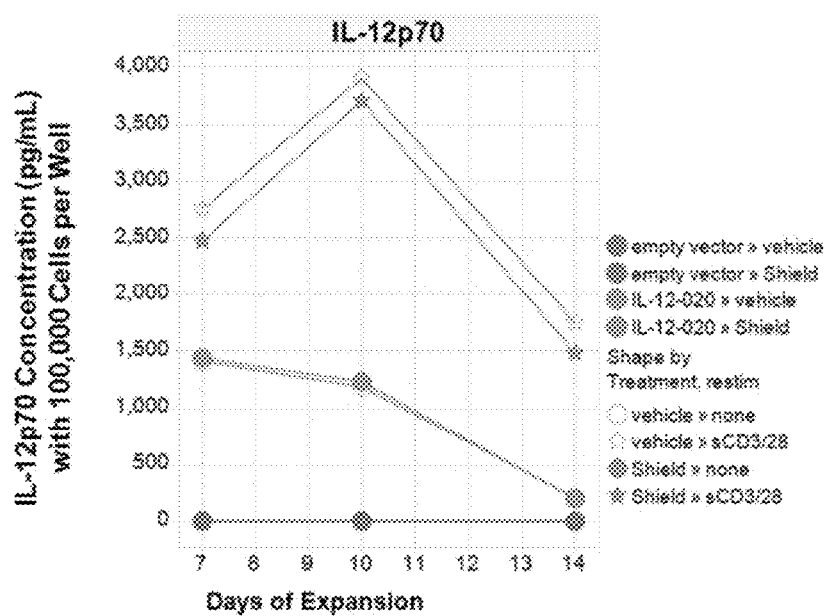

Example 68. Shield-1 can Induce ~40-50× Increases in IL12 Production by Primary Human T Cells Transduced with the IL12-026 Construct On Day 0, primary human T cells were stimulated with Dynabeads (T-expander CD3/CD28) at a 3:1 bead:cell ratio. The next day, lentiviruses (empty vector (pLVX-EF1a-IRES-Puro), OT-IL12-020 (constitutive), or OT-IL12-026 (regulated)) were added at a multiplicity of infection (MOI) of 10 in the presence of LentiBOOST and 5% FBS. On day 2, the cells were washed to remove the LentiBOOST and the bead:cell ratio was reduced to 1:3, and fresh 10% media and IL2 were added. On days 6, 9, and 13 the cells were counted for equal cell number plating, media replaced, ligand was added, and cells were either left unstimulated or restimulated with soluble ImmunoCult™ Human CD3/CD28 T Cell Activator (StemCell Technologies). After overnight incubation (on days 7, 10, and 14), the supernatants were collected for IL12p40 and p70 MSD assay, and transduction efficiency was analyzed by FACS. OT-IL12-026 T cells were found to be 7% transduced, and OT-IL12-020 (constitutive) T cells were 13% transduced on day 7. Restimulation was shown to increase the expression of IL12 (FIG. 43A). Ligand increased production of IL12 by 10-day expanded OT-IL12-026 expressing T cells by 40-50 fold (FIG. 43B and FIG. 43C).

Example 69. Dose Response of Shield-1 on Transduced T Cells

Human T cells were activated with CD3/CD28 Dynabeads (Life Technologies) for 1 day prior to transduction with lentiviruses (OT-IL12-026 or vector control), followed by 12-13 days of expansion in culture. T cells that had been transduced with different amounts of virus (4-40 MOI) were exposed to either a dose response of Shield-1 for 24h (left panel). T cells that had been transduced at an MOI of 14 were treated with 1 uM Shield-1 or vehicle control for increasing amounts of time (right panel). The levels of IL2 that had accumulated in the supernatants (from 100,000 cells per 200 uL media) were measured using human IL12p40 MSD V-plex assay kits (Meso Scale Discovery).

Figure 44A:
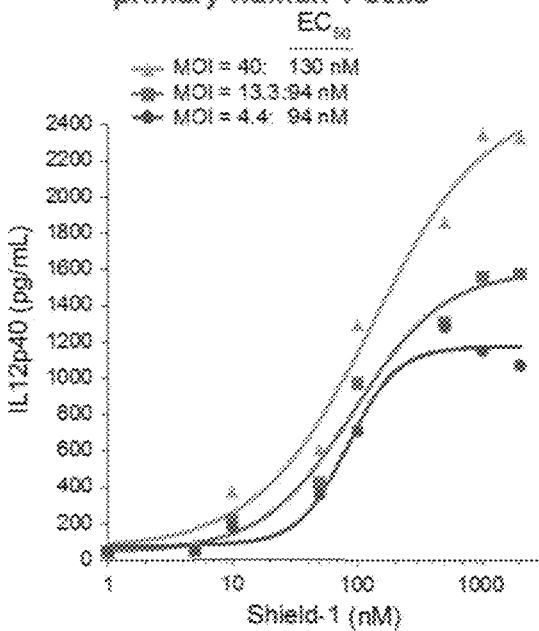
FIG. 44A-FIG. 44B show ligand concentration-dependent and time course of IL12 production by T cells with regulated IL12 construct.
Figure 44B:
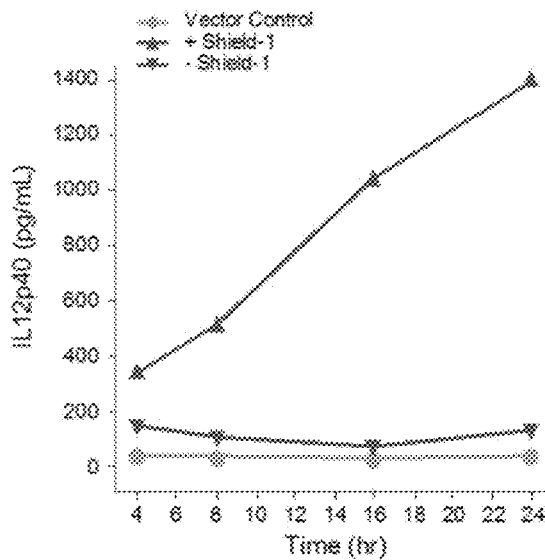

From the analysis, it was shown that the increase in IL12 production by T cells expressing OT-IL12-026 is dose responsive to the ligand, Shield-1 FIG. 44A, and accumulates over time FIG. 44B.

Example 70. In Vivo Dose Response, and Repeat Dosing of AquaShield in NSG Mice with Transferred T Cells Expressing OT-IL12-026

Figure 45A:
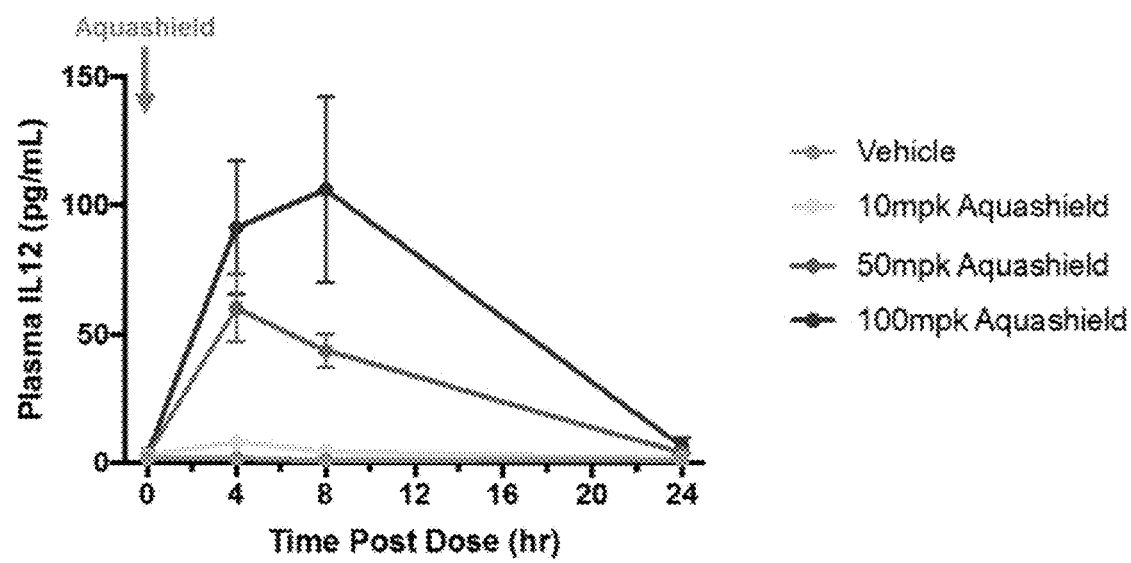
FIG. 45A-FIG. 45B show in vivo dose response and repeat dosing in mice with transferred T cells expressing IL12 constructs.

Primary human T cells were stimulated with Dynabeads (T-expander CD3/CD28) at a 3:1 bead:cell ratio. The next day, lentiviruses (OT-IL12-020 (constitutive), OT-IL12-026 (regulated), or vector control) were added at a multiplicity of infection (MOI) of 10 in the presence of LentiBOOST and 5% FBS. The following day, T cells were washed to remove the LentiBOOST and the bead:cell ratio was reduced to 1:3, and fresh 10% media and IL2 were added. The T cells were expanded for a total of 10 days, and then $25 \times 10^6$ vector control or OT-IL12-026 transduced T cells or $10 \times 10^6$ constitutive OT-IL12-020 transduced T cells were transferred into NSG mice (study day 0). Three days after cell transfer, the animals were dosed with either vehicle or AquaShield (10, 50 or 100 mg/kg). Blood was sampled for plasma analysis of IL12p70 by MSD assay at 0, 4, 8, and 24h post dosing (FIG. 45A). Clear dose responsive increases in plasma IL12 was observed.

Figure 45B:
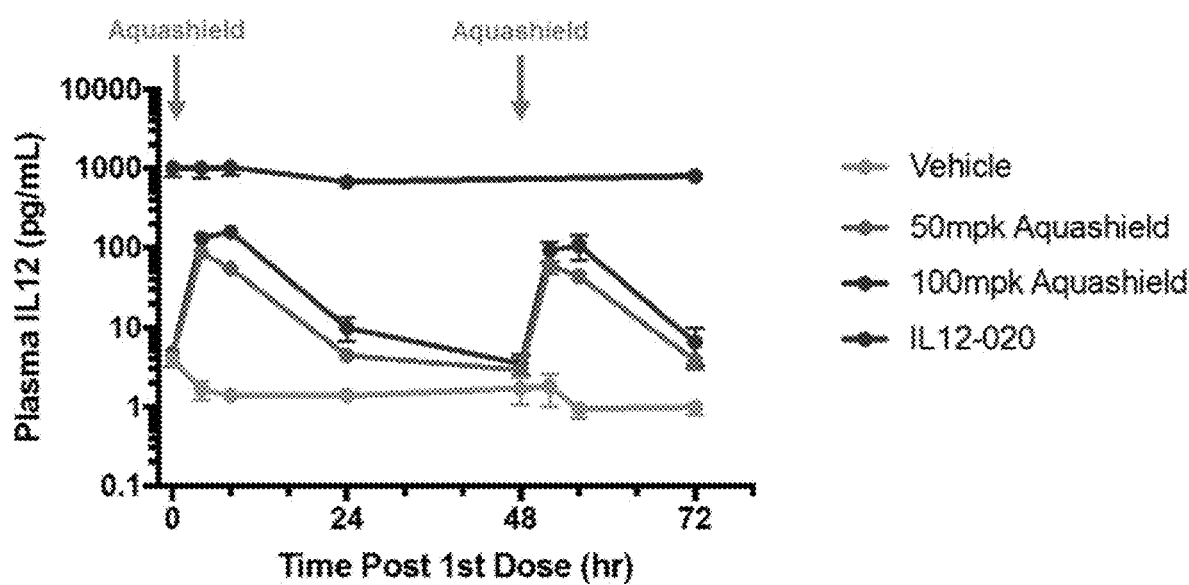

On day 5 post T cell transfer, animals were dosed a second time with AquaShield (FIG. 45B). A second increase in plasma IL12 was observed upon repeat dosing with AquaShield.

Example 71. In Vivo Regulation of DD-12 Expressed in T Cells

To determine whether ligand can stabilize DD-IL12 in vivo upon sequential dosing of AquaShield, T cells are transduced with DD-IL12-expressing constructs (OT-IL12-020 or OT-IL12-026) and implanted into mice (n=4 per group) (day 0) as outlined in the study design below.

TABLE 88

Study Design

| Group | Description |
|---|---|
| A | Empty Vector, Day 3-6: oral vehicle daily for 4 days |
| B | OT-IL12-020, Day 3-6: oral vehicle daily for 4 days |
| C | OT-IL12-026: Day 3-6: oral vehicle daily for 4 days |
| D | OT-IL12-026, Day 3-6: Aquashield 50 mg/kg orally daily for 4 days |
| E | OT-IL12-026, Day 4 and 6: Aquashield 50 mg/kg orally |
| F | Empty Vector, Day 5 and 10: oral vehicle |
| G | OT-IL12-020, Day 5 and 10: oral vehicle |
| H | OT-IL12-026, Day 5 and 10: oral vehicle |
| I | OT-IL12-026, Day 5 and 10: Aquashield 50 mg/kg orally |
| J | OT-IL12-026, Day 10: Aquashield 50 mg/kg orally |

For each group, a pre-bleed sample is collected as well as samples at 4 hours and 24 hours after each dose. At the end of the study, tissue and organ samples are collected. FACS analysis is conducted to determine cell numbers and Th1 markers.

On Day 0, primary human T cells were stimulated with Dynabeads (T-expander CD3/CD28) at a 3:1 bead:cell ratio. The next day, lentiviruses (empty vector (pLVX-EF1a-IRES-Puro), OT-IL12-020 (constitutive), or OT-IL12-026 (regulated)) were added at a multiplicity of infection (MOI) of 10 in the presence of LentiBOOST and 5% FBS. On day 2, the cells were washed to remove the LentiBOOST and the bead:cell ratio was reduced to 1:3, and fresh 10% media and IL2 were added.

Figure 46A:
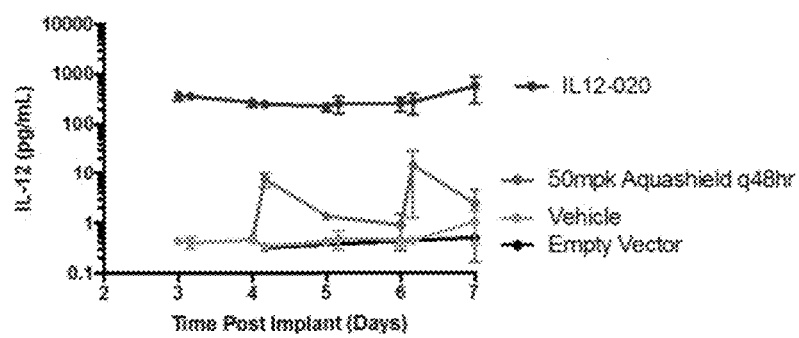
FIG. 46A-FIG. 46F show results of in vivo IL12 expression with T cells expressing IL12 constructs.
Figure 46B:
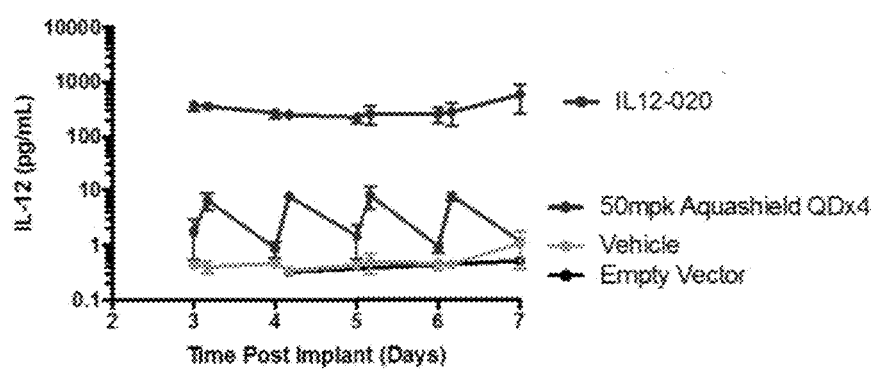
Figure 46C:
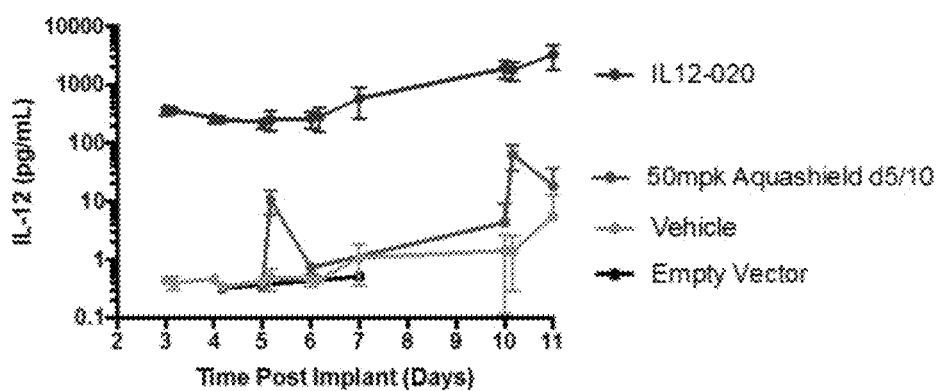

In vitro evaluation of these cells is shown under FIG. 46A-FIG. 46C.

After 10 days of expansion, T cells were injected into NSG mice ($12 \times 10^6$ cells injected, cells were 15% (constitutive) and 7.5% (regulated) IL12 positive by FACS). For each group, a pre-bleed sample was collected as well as plasma samples at 4 hours and 24 hours after each dose. At the end of the study, tissue and organ samples are collected. FACS analysis was conducted to determine T cell numbers in the blood and to assess Th1 phenotypic markers.

As shown in FIG. 46A, IL12 expression in response to sequential pulsed doses of ligand (50 mg/kg Aquashield administered orally on day 4 and 6 (50 mpk Aquashield q48 hr)) was elevated in the plasma of mice with T cells expressing OT-IL12-026 as compared to the vehicle treated controls. T cells expressing the empty vector control did not produce IL12. T cells transduced with OT-IL12-020 (IL12-020), the constitutive control, produced IL12 throughout the time course.

In FIG. 46B, elevated plasma IL12 expression in response to sequential pulsed doses of ligand (50 mg/kg Aquashield administered orally for 4 days (day 3-6) (50 mpk Aquashield QDx4)) was seen in mice bearing OT-IL12-026 expressing T cells as compared to the vehicle treated controls. Cells transduced with OT-IL12-020 (IL12-020), the constitutive control, produced IL12 throughout the time course.

FIG. 46C shows the IL12 expression over 11 days for the constitutive construct OT-IL12-020 (IL12-020). Ligand-regulated expression of IL12 from T cells expressing DD-IL12 from the construct OT-IL12-026 was seen in mice treated with 50 mg/kg Aquashield administered orally on day 5 and 10 (50 mpk Aquashield d5/10). T cells expressing the empty vector control did not produce IL12.

Figure 46D:
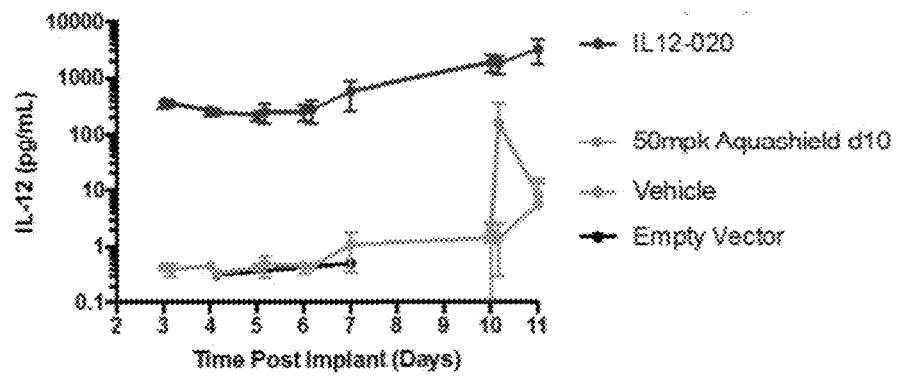

FIG. 46D shows ligand-induced regulation of plasma IL12 expression from T cells expressing DD-IL12 from the construct OT-IL12-026 when mice were treated orally with 50 mg/kg Aquashield on day 10 (50 mpk Aquashield d10). The single ligand pulse increased plasma IL12 levels over those detected in vehicle-treated control mice harboring OT-IL12-026 expressing T cells.

Figure 46E:
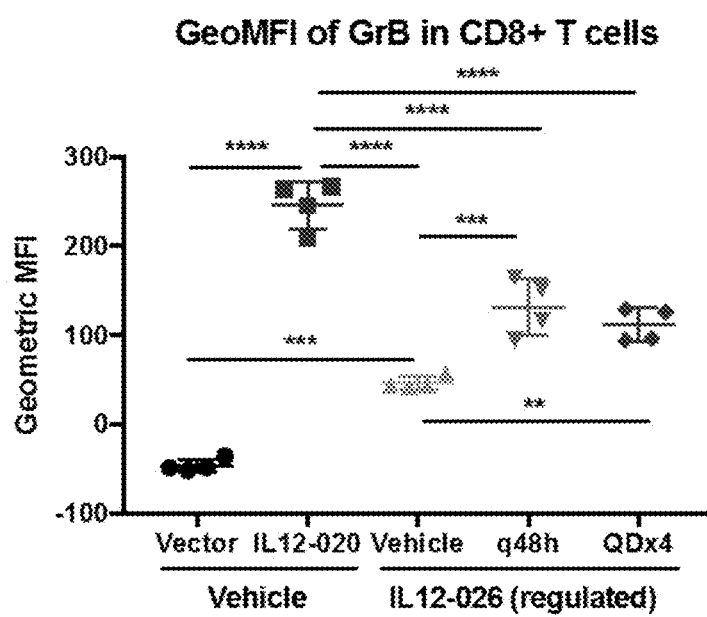
Figure 46F:
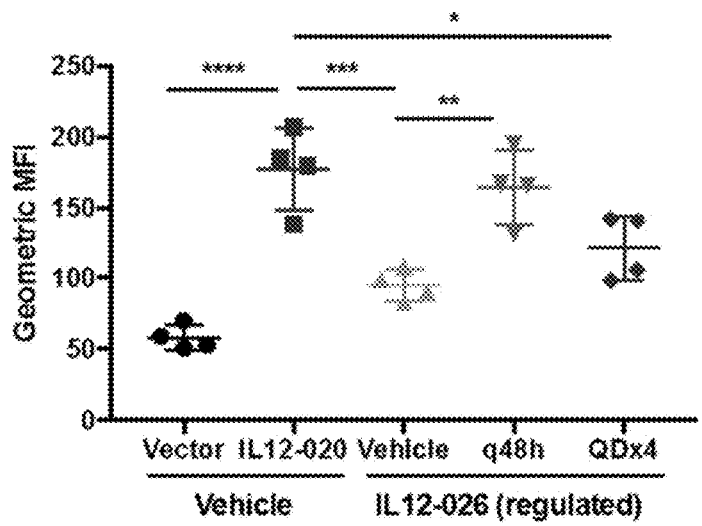

Regulation of IL12 for all constructs shown in FIG. 46A-FIG. 46D did not impact IFNγ levels, instead the levels of IFNγ gradually rose over time. This is likely due to the exposure of the T cells to IL12 in culture during the in vitro expansion phase. However, ligand-induced regulation of IL 12 increased granzyme B (GrB) (FIG. 46E) and perforin expression (FIG. 46F) by CD8+ T cells in vivo at day 7 post in vivo T cell transfer.

Example 72. Effect of PGK Promoter and N-Terminal FKBP

HEK293T cells were transiently transfected with Lipofectamine 3000 and 2 ug plasmid DNA each of: OT-IL12-019 (PGK promoter), OT-IL12-020 (EF1alpha promoter), OT-IL12-025 (PGK promoter, C-terminal FKBP domain), OT-IL12-026 (EF1alpha promoter, C-terminal FKBP domain), OT-IL12-046 (N-terminal FKBP). Ligand (1 uM Shield-1) was added one day after transfection, and the cells were further cultured for 2 more days. IL12 secretion into the supernatants was quantitated by IL12p40 MSD assay. Genomic DNA (gDNA) and messenger RNA (mRNA) was purified from the cells. The levels of construct DNA integration into the cellular genome and levels of IL12 mRNA expression were quantitated by qPCR using primers specific to the WPRE element and IL12 within the respective constructs.

Figure 47A:
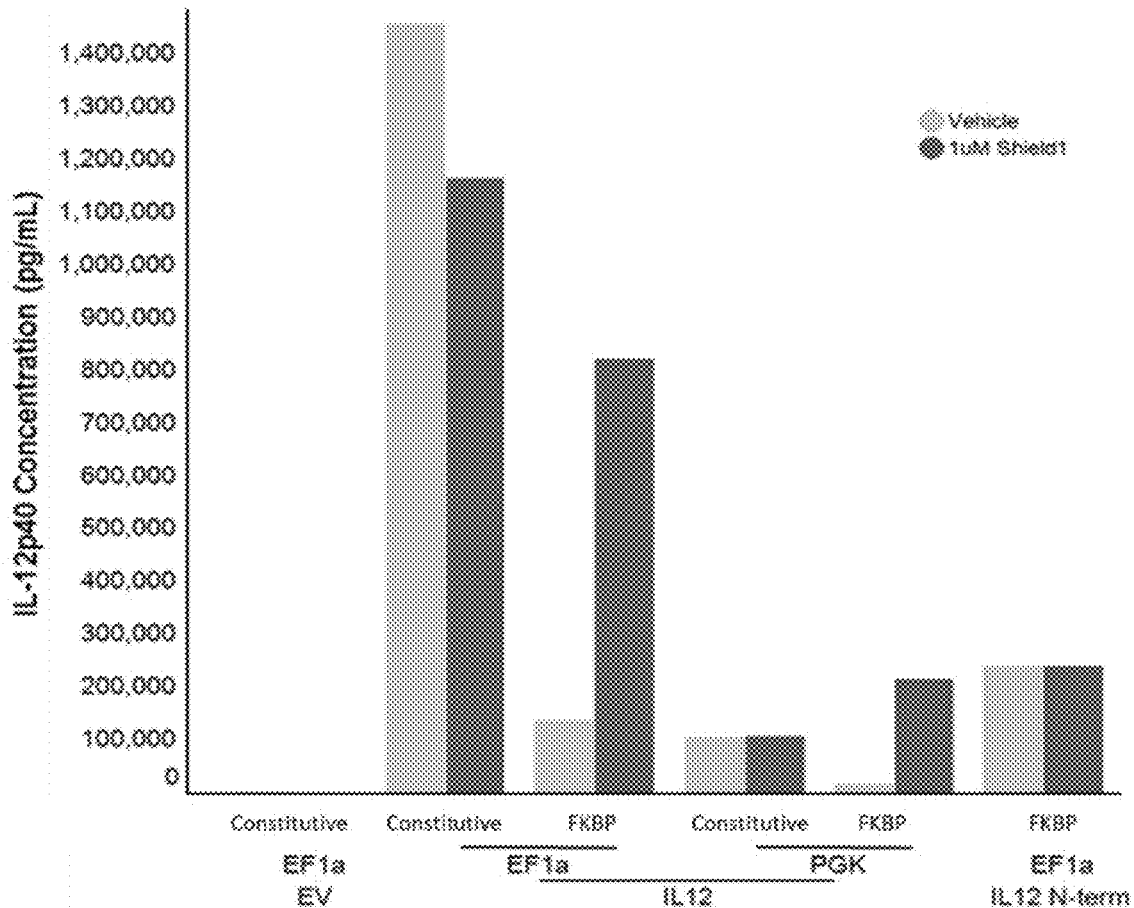
FIG. 47A-FIG. 47B show effects of a PGK promoter and an N-terminal FKBP in contructs expressing IL12.

The gDNA qPCR analysis demonstrated that the FKBP DD-containing constructs had integrated to similar levels within the cellular genomes, and that the PGK promoter, as expected, generated less IL12 mRNA expression than the EF1alpha promoter (FIG. 47A).

Figure 47B:
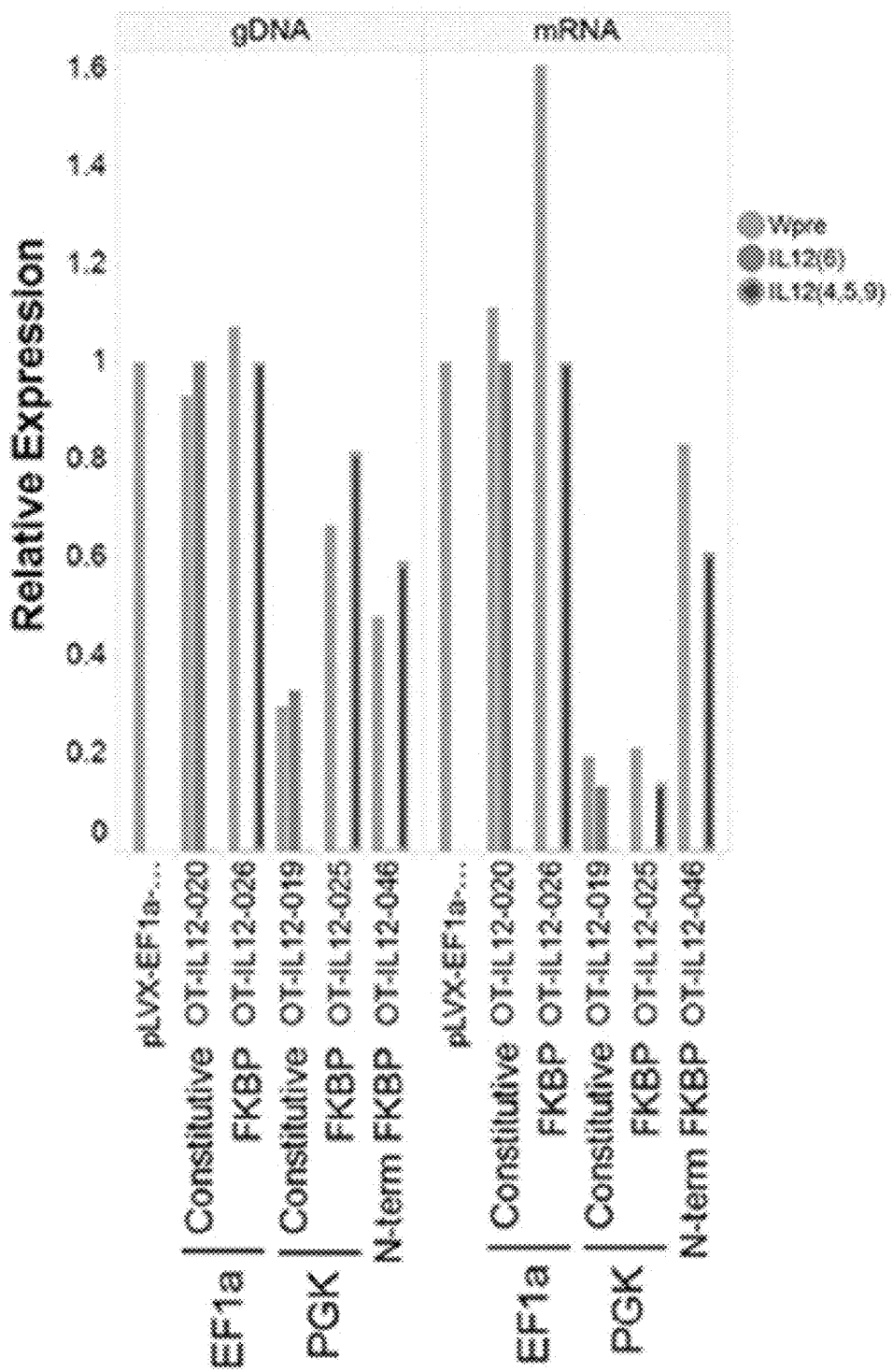

Due to the lower levels of mRNA transcription induced by the PGK promoter, the IL12p40 MSD assay also demonstrated that the PGK promoter reduced both basal and peak IL12 levels of secretion as compared to the construct using the EF1alpha promoter. The lower basal levels of IL12 production downstream of the PGK promoter resulted in ~2 fold improved ligand-induced IL12 regulation as compared with the construct with the EF1alpha promoter (FIG. 47B). More specifically, the ligand-induced regulation of IL12 expression increased from 6-fold to 13-fold with the change from the EF1alpha to the PGK promoter, respectively.

Constructs containing FKBP either at the N-terminus or at the C-terminus of IL12 were integrated similarly into the cellular genome and generated similar levels of mRNA (FIG. 47A). However, while C-terminal containing FKBP constructs regulate IL12 expression, the N-terminal-containing FKBP construct failed to regulate IL12 expression (FIG. 47B).

Example 73. Kinetics of Ligand-Dependent Stabilization of DD-IL15-IL15Ra

Figure 48:
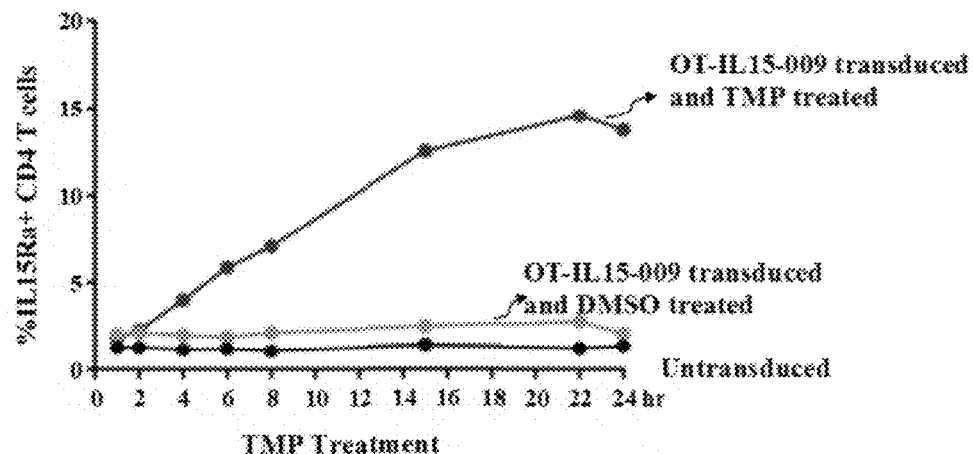
FIG. 48 depicts the kinetics of IL15Ra surface expression on CD4 T cells after TMP treatment.

The on/off kinetics of ligand-dependent stabilization of DD-IL15-IL15Ra was measured in CD4 positive T cells. T cells were activated with CD3/CD28 beads at 3:1 bead to T cell ratio in 24-well plates for 24 hrs. Lentivirus was added to wells in the presence of LentiBoost reagent, and cells were incubated for another 24 hrs and washed. Cells were resuspended in fresh media, and media was added every 2-3 days to expand and maintain cells at $0.5\text{-}1\times10^6$/ml. After 7 days of expansion, T cells transduced with the ecDHFR DD-IL15-IL15Ra fusion construct (OT-IL15-009) were treated with 100 μM ecDHFR ligand Trimethoprim (TMP) or vehicle control, DMSO. At multiple time points (i.e., 1, 2, 4, 6, 8, 15, 22 and 24 hrs) after TMP treatment, the transduced T cells were collected and analyzed for IL15Ra surface expression using anti-IL15Ra antibodies by flow cytometry. Untransduced T cells were used as a negative control. The T cells were sorted into CD4 positive and CD8 positive populations and the percentage of IL15Ra positive CD4 positive T cells was analyzed. FIG. 48 shows the kinetics of surface expression of IL15Ra on CD4 T cells after TMP treatment. Among the CD4 positive T cells transduced with the OT-IL15-009 construct, the proportion of cells with surface expression of IL15Ra remained similar for both TMP treated and DMSO treated cells until 2 hrs after TMP treatment, and was comparable to that of untransduced cells. However, from 4 hrs after TMP treatment, the cells transduced with the OT-IL15-009 construct and treated with TMP exhibited an increased proportion of cells with surface expression of IL15Ra. This trend was observed until 22 hours after treatment with TMP. The CD4 positive T cells with surface-expressed IL15Ra cells constituted ~1% of untransduced cells, indicating that the proportion of cells that expressed endogenous IL15Ra is low.

Figure 49:
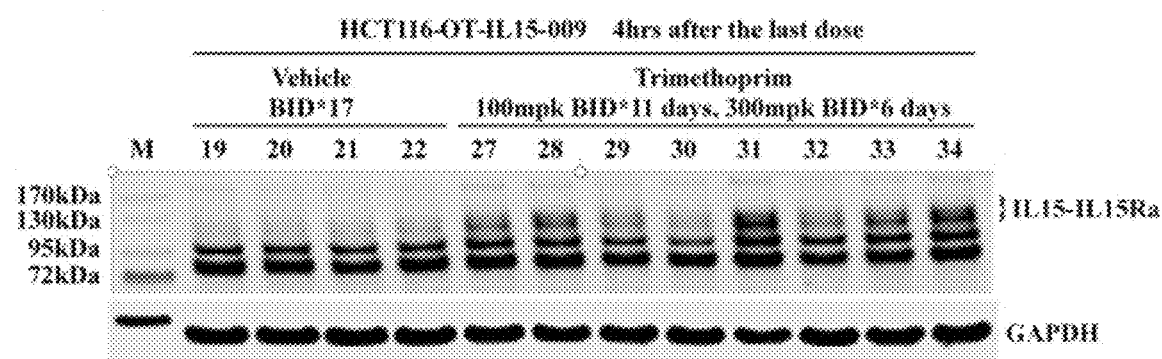
FIG. 49 represents a western blot of IL15-IL15Ra protein in HCT116 tumors from mice treated with TMP for 17 days in xenograft assays.

Example 74. Ligand-Dependent Stabilization of DD-IL15-IL15Ra Fusion Molecules In Vivo To examine whether ligand treatment induces stabilization of the DD-IL15-IL15Ra fusion molecules in vivo, HCT116 cells transduced with the OT-IL15-009 construct were implanted subcutaneously in BALB/c nude mice and treated with TMP. TMP was orally administered to mice at a dose of 100 mg/kg, twice a day for 11 days after implantation, followed by administration of TMP at the dose of 300 mg/kg, twice a day for 6 days. As a negative control, separate mice implanted with HCT116 cells transduced with the OT-IL15-009 construct were treated with the vehicle twice a day for 17 days. At 4 hrs after the last dosing of TMP or the vehicle control, tumors were harvested from the mice and analyzed for the levels of IL15-IL15Ra fusion molecules by western blotting. As shown in FIG. 49, HCT116 tumors harvested from mice treated with TMP exhibited elevated levels of IL15-L15Ra expression, compared to tumors treated with the vehicle. The GAPDH level was analyzed as a loading control. These data show that administration of ligand enabled stabilization of the DD-IL15-IL15Ra fusion molecule in vivo.

Consistent with the efficacy of TMP-dependent IL15-IL15Ra stabilization in vivo, elevated levels of TMP (399.38 ng/g tumor) were observed in HCT116 tumors harvested from mice treated with TMP for 17 days. The levels of TMP associated with HCT116 tumors were considerably higher than those observed in mouse plasma at day 3 (15.67 ng/ml plasma) and at day 17 (99.5 ng/ml plasma), indicating that the orally administered TMP was successfully delivered to and accumulated in HCT116 tumors implanted in mice.

Example 75. Shedding Resistant IL15-IL15Ra Constructs

To maintain the efficiency of the trans-presentation of IL15 via the IL15-IL15Ra fusion molecule, the IL15-IL15Ra shedding needs to be prevented. For this purpose, new DD-IL15-L15Ra and constitutive IL15-IL15Ra constructs are designed through a variety of modifications on the IL15-IL15Ra fusion molecule. For example, the IL15 molecule or the IL15Ra molecule is truncated or mutated to remove presumable cleavage sites. IL15Ra has a cleavage site (PQGHSDTT from the position 168 to 175 of SEQ ID NO. 2752) in the extracellular domain immediately distal to the transmembrane domain of the receptor, as described by Bergamaschi C et al. (2008). J Biol Chem 283(7):4189-99; Anthony S M et al. (2015). PLoS One. 10(3): e0120274), and International Patent Application Publication Nos. WO2014066527 and WO2009002562 (the contents of each of which are incorporated herein by reference in their entirety). Tumor necrosis factor-alpha-converting enzyme (TACE/ADAM17) has been implicated as a protease that cleaves between glycine (at the position 170 of SEQ ID NO. 2752) and histidine (at the position 171 of SEQ ID NO. 2752) and generates a naturally occurring soluble form of IL15Ra. The same mechanism can be responsible for the IL15-IL15Ra shedding. Hence, the cleavage site of IL15Ra is mutated such that cleavage by an endogenous protease is prevented. The mutation of the cleavage site is introduced by substitution, insertion or deletion of amino acid residues. The IL15-IL15Ra fusion molecule is also modified such that the full-length or truncated IL15-IL15Ra fusion molecule is fused to heterologous hinge domains and/or heterologous transmembrane domains. As non-limiting examples, variants of IL15Ra can be utilized. Additionally, the length and sequence of the linkers that connect IL15 and IL15Ra are modified.

To confirm that the modifications on the IL15-IL15Ra fusion molecule prevent shedding, the new DD-IL15-IL15Ra or constitutive IL15-IL15Ra constructs are introduced into HCT-116 cells. Surface expression of IL15 and IL15Ra on the HCT-116 cells is examined by flow cytometry using anti-L15 and IL15Ra antibodies to assess surface IL15-IL15Ra shedding. The presence or absence of IL15 in the cell culture supernatant is also analyzed by MSD assay. As a functional assay based on the sensitivity of NK cell activation by shed IL15 in tumor supernatant, the transwell assay is conducted using HCT-116 cells transduced with new DD-IL15-IL15Ra or constitutive IL15-IL15Ra expressing constructs and NK cells. The new DD-IL15-IL15Ra-expressing constructs that do not induce activation of NK cells in the presence of ligand and the new constitutive IL15-IL15Ra-expressing constructs that do not induce activation of NK cells are chosen for use in future experiments.

Example 76. Regulated Expression of IL15-IL15Ra Fusion Molecule with C-Terminal DD A fusion molecule is generated by fusing membrane bound IL15, IL15 Receptor alpha subunit (IL15Ra) and a human DHFR (DD). These fusion molecules were cloned into pLVX-EF1a-IRES-Puro vector.

To test ligand dependent IL15-IL15Ra production, 1 million HEK-293T cells were plated in a 6-well plate in growth media containing DMEM and 10 FBS and incubated overnight at 37° C., 5% CO2. Cells were then transfected with 100 ng of constitutive IL15-IL15Ra (OT-IL15-008) or DD linked IL15-IL15Ra (OT-IL15-037 or OT-IL15-040) using Lipofectamine 2000 and incubated for 24 hrs. Following the incubation, media is exchanged for growth medium with or without 50 µM Trimethoprim (TMP) and further incubated for 48 hrs. Cells were harvested and IL15 levels are analyzed via western blotting using human IL15 antibody (Abcam, Cambridge, UK). The molecular weight of IL15Ra in OT-IL15-037 and OT-IL15-040 appeared to be the same as OT-IL15-008.

Figure 50:
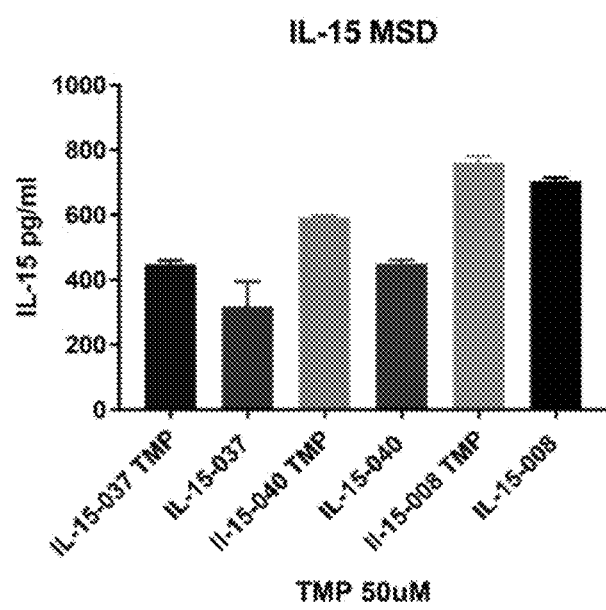
FIG. 50 is a graph of the results of the MSD assay of IL15 protein levels in HEK293 cells.

To test if IL15 is shed into the media, supernatant from HEK293 cells expressing IL15-IL15Ra fusion constructs was subject to immunoassays such as MSD (Rockville, Md.). 48 hours after transfection, cells were analyzed and, as expected, constitutive IL15-IL15Ra construct OT-IL15-008 showed high surface expression of IL15 in the presence and absence of ligand. OT-IL15-037 and OT-IL15-040 showed the ligand (Trimethoprim) dependent surface expression of IL15 and IL15Ra (FIG. 50). The detection of membrane bound IL15-IL15Ra fusion constructs in the supernatant suggests that L15 constructs are likely shed from the cell surface.

Figure 51A:
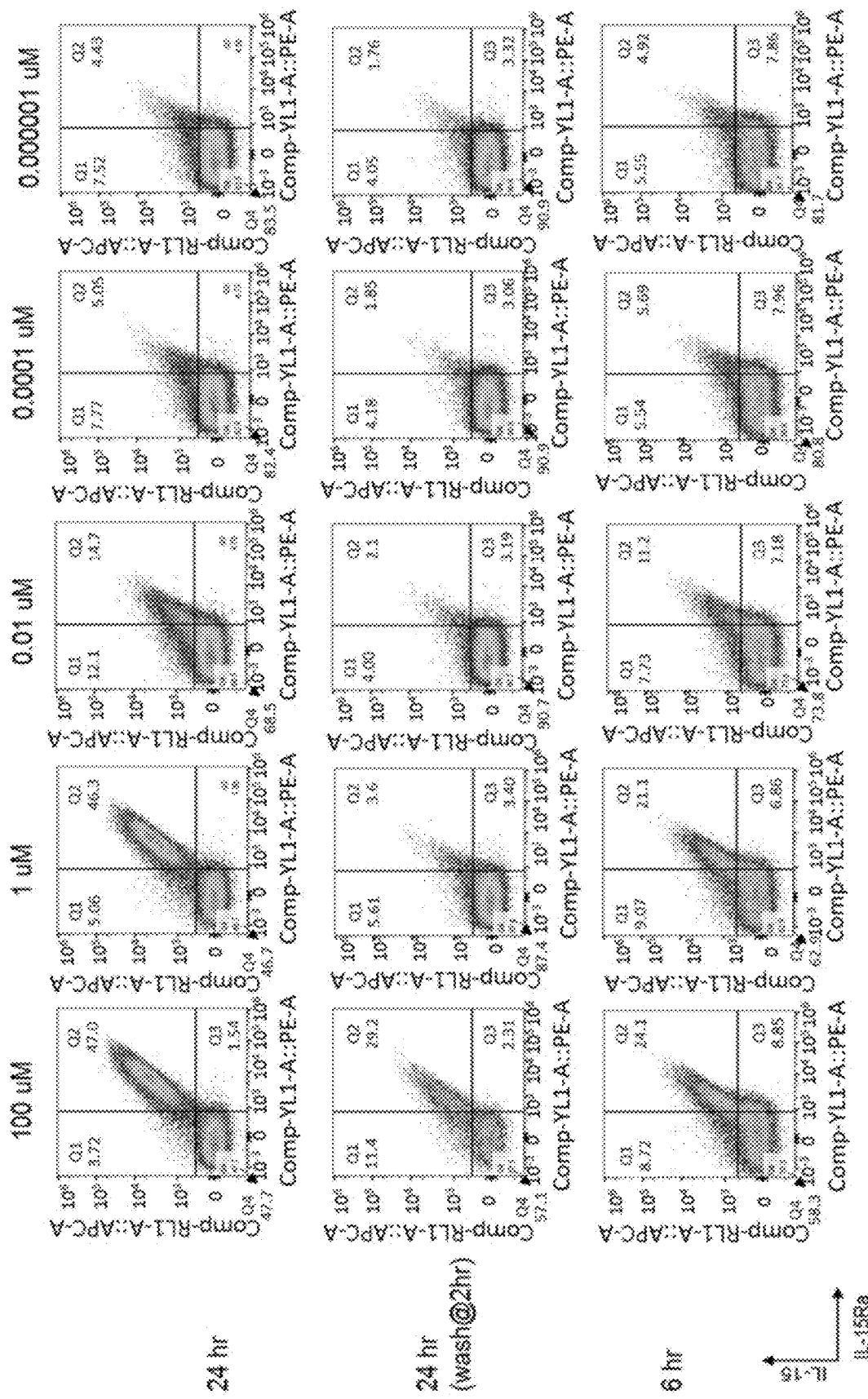
FIG. 51A-FIG. 51B depict membrane bound IL15 expression.
Figure 51B:
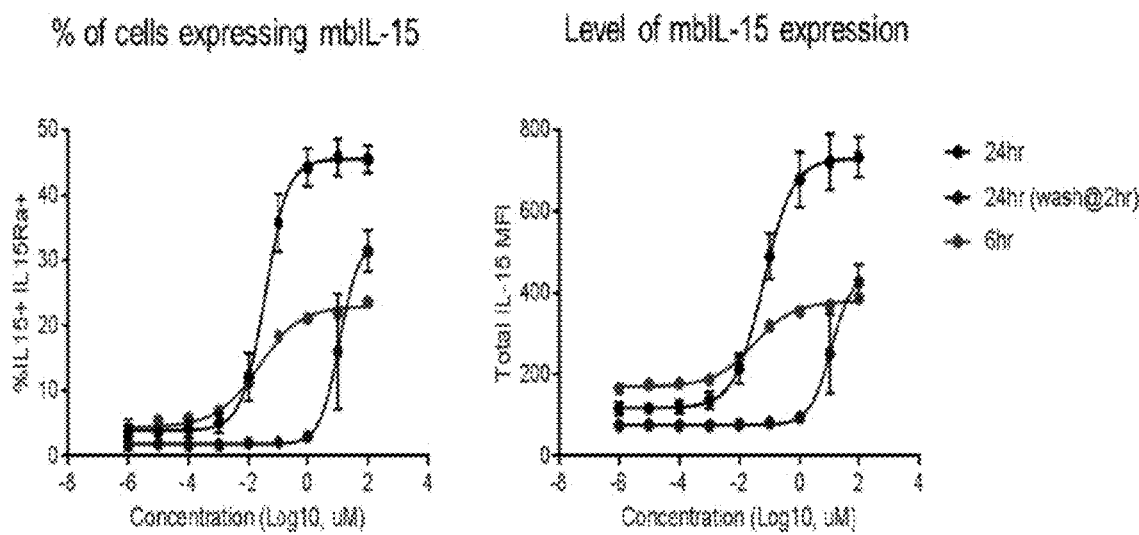

Example 77. Effect TMP Exposure to TMP In Vitro on Membrane Bound IL15 Expression In order to determine if the dose and time of exposure to TMP in vitro influenced membrane bound IL15 expression, an in vitro dose response study was conducted with T cells expressing OT-IL15-073. For this purpose, T cells were activated with CD3/CD28 beads at 3:1 bead to T cell ratio in 24-well plates for 24 hrs. Lentivirus was added to wells. After 24 hrs, fresh media was added every 2-3 days to expand cells while maintaining cells at $0.5-1\times10^6$/ml. On day 11 of expansion. T cells treated with TMP starting at 100 uM, 10× dilutions and 9 points were analyzed after 2 hours in culture (washed 3× after TMP addition, fresh media added without TMP for 22 hours), 6 hours in culture, or 24 hours in culture and the results are shown in FIG. 51A. As shown in FIG. 51B and Table 89, this study showed that TMP ligand regulates membrane bound IL15 expression and the dose and time of exposure to TMP in vitro influences membrane bound IL15 expression.

TABLE 89

Membrane Bound IL15 Expression

| TMP Treatment | EC50, uM (% IL15 + IL15Ra+) | EC90, uM (% IL15 + IL15Ra+) | EC50, uM (total IL15 MFI) | EC90, uM (total IL15 MFI) |
|---|---|---|---|---|
| 24 hour | 0.035 | 0.255 | 0.063 | 0.75 |
| 24 hour (wash at 2 hours) | 11.5 | 59.6 | 11.1 | 66.9 |
| 6 hours | 0.021 | 0.81 | 0.030 | 0.88 |

Example 78. Regulated Membrane Bound IL15 Expression In Vivo

To evaluate regulation of membrane bound IL15 in vivo, 2 constructs were selected for evaluation in vivo. Four group of T cells were used for this study and are outlined in Table 90. In Table 90, "N" represents the number of mice in each group.

TABLE 90

T Cell Groups

| Group | N | T Cells | Treatment |
|---|---|---|---|
| 1 | 4 | Untransduced | — |
| 2 | 4 | OT-IL15-071 (pELNS vector, EF1a promoter, membrane bound IL15 sequence from OT-IL15-008) | — |
| 3 | 4 | OT-IL15-073 (pELNS vector, EF1a promoter, membrane bound IL15 sequence from OT-IL15-009) | Vehicle |
| 4 | 4 | OT-IL15-073 (pELNS vector, EF1a promoter, membrane bound IL15 sequence from OT-IL15-009) | TMP |

The T cells which were to be used as part of the in vivo study were evaluated 6 days post transduction, day of implant (day 9 post transduction) and 13 days post transduction and the cells in Groups 2-4 showed expression of the constructs.

T cells outlined in Table 90 were administered to mice by intravenous administration ($3.9\times10^6$ cells per mouse implanted). On day 3 the mice were dosed with 500 mg/kg of TMP 3 times (4 hours between doses) and bled 2 hours after each dose. The mice were again bled on day 4, 24 hours after the first TMP dose.

Figure 52A:
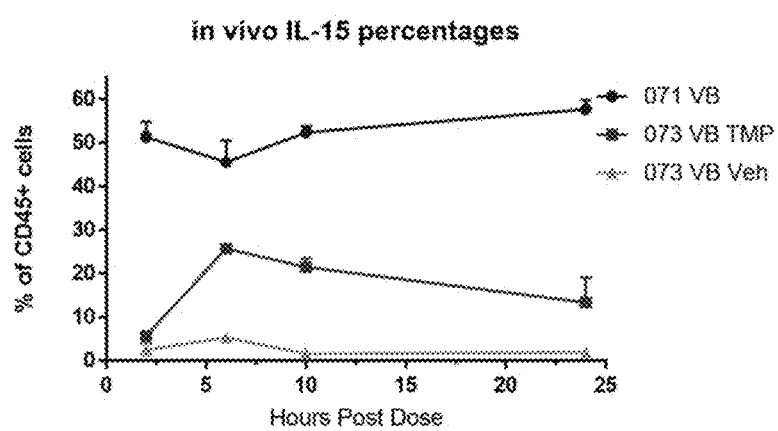
FIG. 52A-FIG. 52F show analyses of regulated membrane bound IL15 expression in vivo.
Figure 52B:
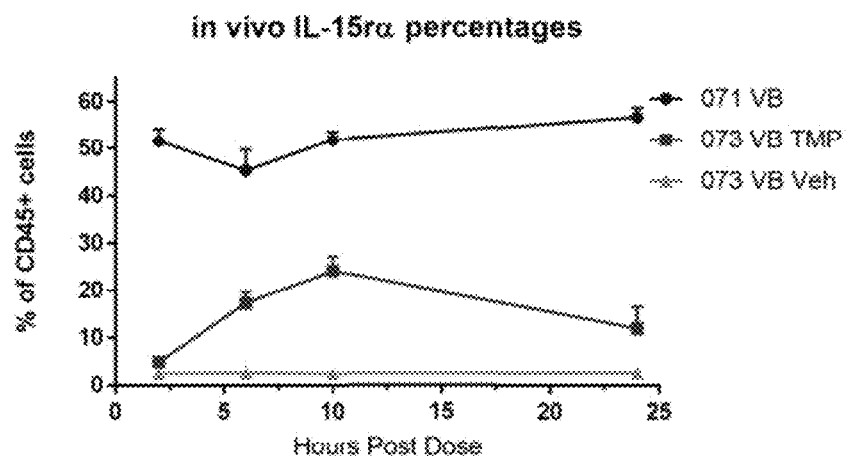
Figure 52C:
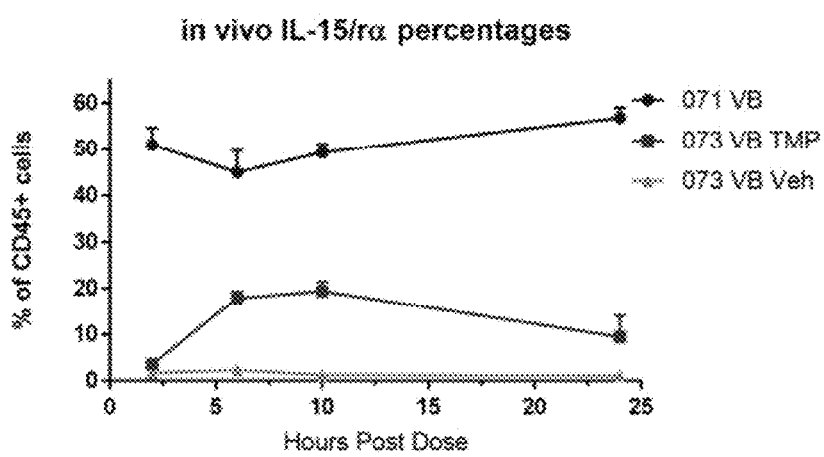
Figure 52D:
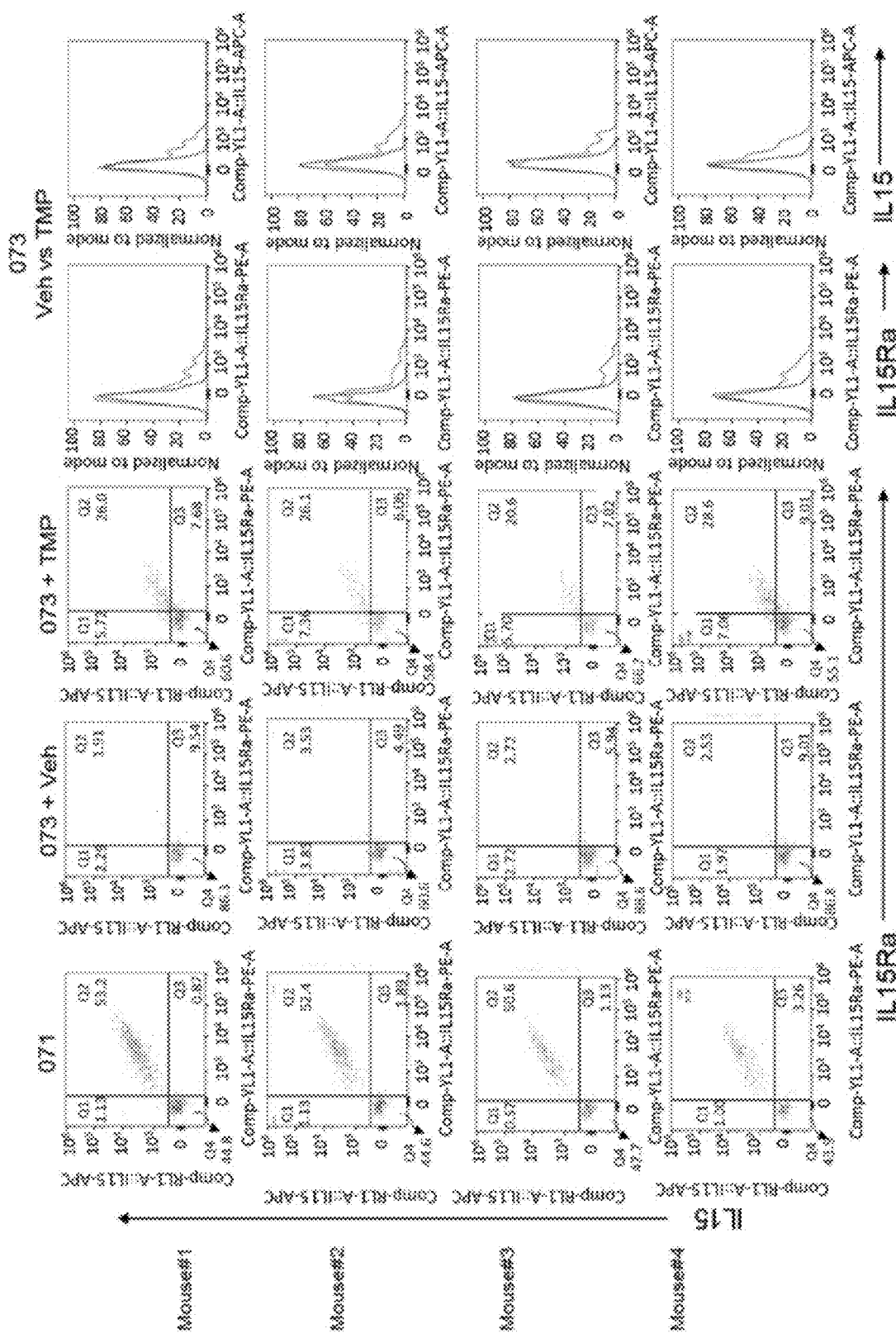
Figure 52E:
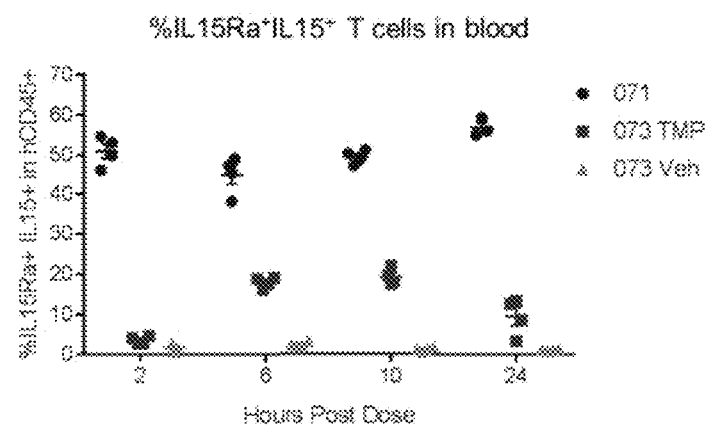
Figure 52F:
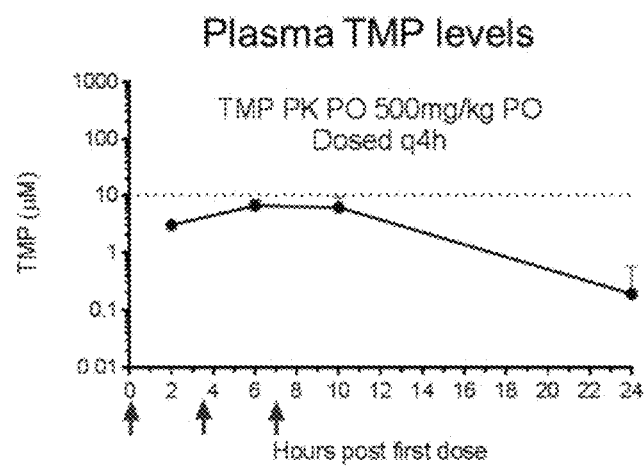

FIG. 52A-FIG. 52C show the expression of membrane bound IL15, 2, 6, 10, and 24 hours after the first TMP dose, using IL15 staining (FIG. 52A), IL15Ra staining (FIG. 52B), and IL15/IL15Ra double ++ staining (FIG. 52C). FIG. 52D are FACS plots for each mouse 10 hours after the first TMP dose. FIG. 52E shows the expression of membrane bound IL15 in blood 2, 6, 10, and 24 hours after the first TMP dose and FIG. 52F shows the plasma TMP levels 2, 6, 10, and 24 hours after the first TMP dose.

Example 79. Effect of Long Term Intraperitoneal (IP) or Oral (PO) TMP Dosing on T Cell Function In this study, T cells transduced with OT-IL15-071 or OT-IL15-073 (no lentiBoost) were administered intravenously to mice ($15 \times 10^6$ per mouse). 6 study groups were evaluated for this study: (1) untransduced, (2) OT-IL15-071 T cells, (3) OT-IL15-073 PO vehicle, (4) OT-IL15-073 PO TMP 500 mg/kg), (5) OT-IL15-073 IP vehicle, and (6) OT-IL15-073 IP TMP 300 mg/kg. The study design is shown in Table 91. PO dosing is 500 mg/kg TMP in 0.1M citrate and IP dosing is 300 mg/kg TMP lactate in water.

TABLE 91

Study Design

| Timepoint | Dose | Sample Collection |
|---|---|---|
| Day −3 | Inject T cells in mice by IV administration | — |
| Day 0 | PO 1x or IP 1x | — |
| 4 hours | PO 1x | — |
| 6 hours | — | Bleed (survival) |
| 24 hours | PO 2x or IP 1x | Bleed (survival) |
| Day 2 | PO 1x or IP 1x | — |
| Day 3 | PO 1x or IP 1x | — |
| Day 4 | PO 2x or IP 1x | — |
| 120 hours | PO 2x or IP 1x | Bleed (survival) |
| 126 hours | — | Bleed (survival) |
| Day 6 | PO 2x or IP 1x | — |
| Day 7 | PO 2x or IP 1x | — |
| Day 8 | — | Bleed (survival) |
| Day 19 | — | Bleed (survival) |
| Day 25 | — | Bleed (terminal) |

The regulated expression in blood was analyzed 6 hours and 24 hours after the first dose, and 6 hours after the $5^{th}$ dose.

OT-IL15-071 showed expression of membrane bound IL15 and the untransduced control did not show any expression.

Regulation of membrane bound IL15 was seen with repeat PO and IP dosing. As seen in FIG. 53, regulated expression of membrane bound IL15 was detected 6 hours after the first dose on day 0, and 6 hours after dosing on day 5 (126 hrs) with both PO and IP dosing. There was no increase in expression in mice treated with vehicle.

Example 80. IL15 Shedding

Figure 54B:
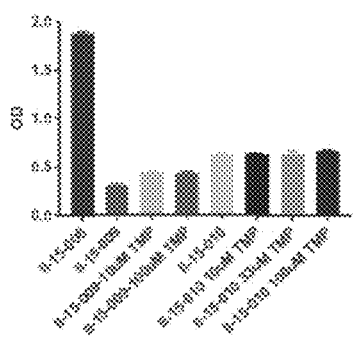
Figure 54C:
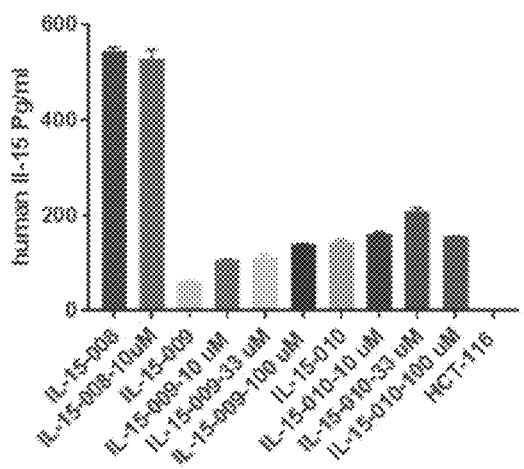

To test if IL15 is shed into the media, supernatant from HCT116 cells expressing IL15-IL15Ra fusion constructs was subject to immunoassays such as ELISA and MSD (Rockville, Md.). In FIG. 54B, OD indicates optical density. IL15 was measured in the media of cells expressing IL15-IL15Ra fusion constructs. OT-IL15-009 construct demonstrated a TMP dose dependent increase in L 5 levels detected in the media. The level of IL15 in the media detected with the constitutive construct OT-IL15-008 was much higher than the levels detected with the DD regulated constructs (FIG. 54B). As shown in FIG. 54C, a dose dependent increase in L 5 levels was observed with both the DD regulated constructs using the MSD immunoassay. The detection of membrane bound IL15-IL15Ra fusion constructs in the supernatant suggests that IL15 constructs are likely shed from the cell surface.

Example 81. IL15-IL15Ra In Vivo Tumor Study

Figure 55A:
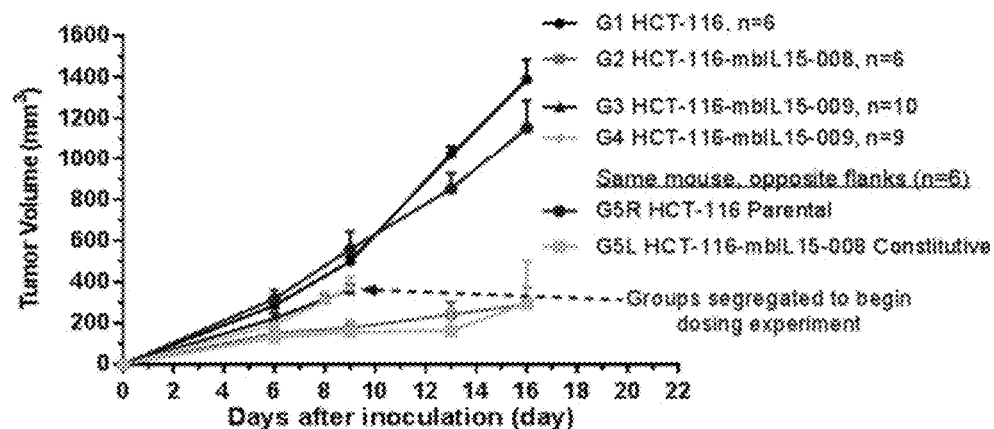
FIG. 55A-FIG. 55B show results from an in vivo tumor study with IL15-IL15Ra constructs.

The functional capability of IL15-IL15Ra constructs was tested in vivo in xenograft assays. The experiment was designed to test the hypothesis that pulsatile expression of IL15-IL15Ra fusion proteins from cancer cell lines such as HCT116, in mice may stimulate the mouse's NK cells to attack the tumor leading to tumor growth inhibition. 5 million HCT116 cells expressing constitutive L5-IL15Ra construct (OT-IL15-008) or DD regulated construct (OT-IL15-009) were implanted subcutaneously into nude mice with 50% matrigel. Tumors were allowed to develop over a period of 22 days. On day 8, mice expressing OT-IL15-009 constructs were separated from the rest of the animals and split into three groups. Group 1 received vehicle control for 7 days, while group2 received 100 mg/kg of Trimethoprim, while the third group did not receive any drug treatment. As shown in FIG. 55A, mice injected with parental HCT116 cells (G1) were able to form tumors. Mice injected with OT-IL15-008 expressing cells (G2) formed very small tumors in comparison. Injecting both the parental (G5R) and the constitutive construct (G5L) in opposite flanks of the same mouse did not affect the tumor growth capacity of either cohort.

Figure 55B:
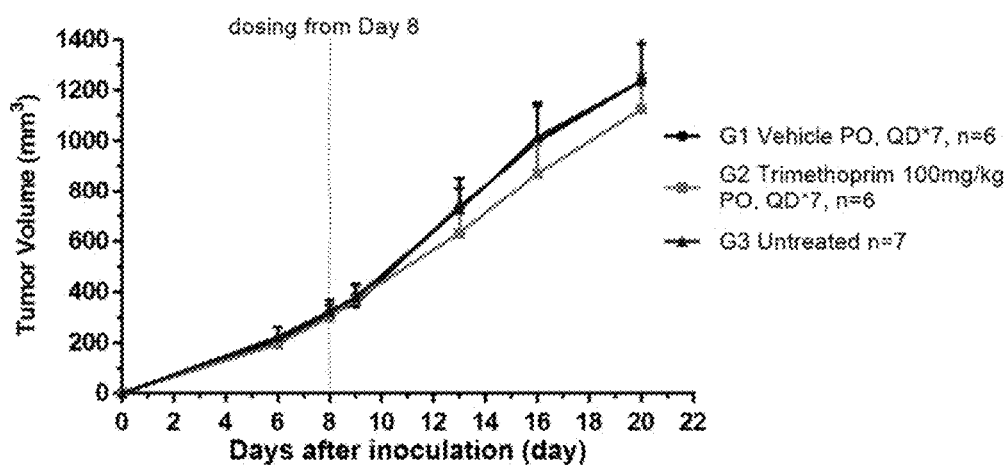

Mice injected with OT-IL15-009 expressing cells were left untreated, or treated with vehicle control or TMP. As shown in FIG. 55B, mice treated with TMP had smaller tumors than mice of the other two groups, suggesting that pulsatile expression of IL15-IL15Ra construct may contribute to anti-tumor activity.

Example 82. EBV Tumor Antigen Mediated TCR Re-Stimulation In Vivo

Human T cells engineered to express DD regulated cytokines are not antigen specific which limits their functional analysis in mice. However, functionality of T cells in vivo requires their restimulation which occurs upon engagement with the antigen. This requirement for antigen mediated restimulation can be mimicked experimentally in mice using the Epstein Barr Virus (EBV) antigen. Approximately 90% adults have a current or a previous EBV infection. Additionally, the major histocompatibility group HLA-A02 has been associated with the decreased risk of developing EBV positive Hodgkin's lymphoma, suggesting that the CTL peptide epitopes that promote EBV clearance are presented by HLA-A02. Tumor cell lines that are HLA-A02 positive e.g. Raji cells are used for in vivo studies. Primary human T cells obtained from various donors are expanded with CD3/CD28 dynabeads. To test reactivity of T cells to the EBV antigen, EBV positive Raji cells and EBV negative Ramos cells are used. The involvement of HLA-A02 in antigen recognition is tested using anti-HLA antibodies with both cell. Cell killing assays are performed by incubating T cells with fluorescently labelled Raji cells or Ramos cells and the ability of the donor T cells to preferentially kill Raji cells is evaluated. The activation of T cells in response to interaction with EBV antigen is measured by culturing mitomycin treated Raji or Ramos cells with fluorescently labelled T cells expressing IL12 or with exogenously supplemented IL12. The activation and proliferation status of T cells is examined by measuring expression of IL2, IFNg, CD107a, Granzyme, Perforin. Since most humans have been exposed to EBV, the donor T cells in most instances are expected to be immunoreactive to Raji cells but not to Ramos cells. It is likely that T cells reactive to Raji cells will be positive for markers of T cell activation such as IL2, Granzyme and Perforin.

Example 83. EBV Tumor Antigen Mediated TCR Re-Stimulation In Vivo

Human T cells engineered to express DD regulated cytokines are not antigen specific. However, functionality of T cells in vivo requires their restimulation which occurs upon engagement with the antigen. This requirement for antigen mediated restimulation can be mimicked in vivo in mice, the Epstein Barr Virus (EBV) antigen may be utilized. Approximately 90% adults have a current or a previous EBV infection. Additionally, the major histocompatibility group HLA-A02 has been associated with the decreased risk of developing EBV positive Hodgkin's lymphoma, suggesting that the CTL peptide epitopes that promote viral clearance are presented by HLA-A02. Several tumor cell lines that are HLA-A02 positive, e.g. Raji cells, are used for in vivo studies. Primary human T cells obtained from various donors are expanded with CD3/CD28 dynabeads. To test reactivity of T cells the EBV antigen, EBV positive Raji cells and EBV negative Ramos cells are used. The involvement of HLA-A02 in antigen recognition is tested using anti-HLA antibodies to test assay specificity. Cell killing assays are performed by incubating T cells with fluorescently labelled Raji cells or Ramos cells and the ability of the donor T cells to preferentially kill Raji cells is evaluated. The activation of T cells in response to interaction with EBV antigen is measured by culturing mitomycin treated Raji or Ramos cells with fluorescently labelled T cells. The activation and proliferation status of T cells is examined by measuring expression of IFNg, CD107a, Granzyme, and Perforin. Since most humans have been exposed to EBV, the donor T cells in most instances are expected to be immunoreactive to Raji cells, but not Ramos cells. It is likely that T cells reactive to Raji cells will be positive for markers of T cell activation such as Granzyme and Perforin.

Example 84. Kinetics of Ligand-Dependent Stabilization of DD-IL15-IL15Ra

To test DD regulated constructs in T cells, OT-IL15-009 construct was transduced into human donor T cells. As additional controls, cells were transduced with constitutive construct OT-IL15-008 or left untransduced. Cells were then treated with 100 μM TMP and IL15Ra expression was measured by FACS using anti-IL 15Ra antibodies and measured against forward scatter. The percentage of IL15Ra positive cells increased from 1.68% in the untreated cells to 16.6% in the TMP treated cells, indicating ligand dependent regulation. Expression of IL15Ra was also compared to untransduced cells in the presence or absence of TMP as well as in control cells constitutively expressing IL15-IL15Ra. In this experiment, it was observed that the percentage of IL15Ra positive cells increased from 1% to 16% in the T cells expressing OT-IL15-009 construct when treated with TMP. This expression level was comparable to cells transduced with the constitutive construct. Untransduced T cells did not show expression of IL15Ra both in the presence and absence of ligand.

The on/off kinetics of ligand-dependent stabilization of DD-L 15-IL15Ra was measured in CD4 positive T cells. T cells were transduced with the ecDHFR DD-IL15-IL15Ra fusion construct (OT-L15-009) and treated with 100 μM ecDHFR ligand Trimethoprim (TMP) or vehicle control, DMSO. At multiple time points (i.e., 1, 2, 4, 6, 8, 15, 22 and 24 hrs) after TMP treatment, the transduced T cells were collected and analyzed for IL15Ra surface expression using anti-IL15Ra antibodies by flow cytometry. Untransduced T cells were used as a negative control. The T cells were sorted into CD4 positive and CD8 positive populations and the percentage of IL15Ra positive CD4 positive T cells was analyzed. Table 92 shows the kinetics of surface expression of IL15Ra on CD4 T cells after TMP treatment. The stabilization ratio was calculated as the fold change in IL15Ra expression in ligand treated samples compared to treatment with DMSO (i.e. in the absence of ligand) with the same construct. The destabilization ratio was calculated as the fold change in IL15Ra levels in the DD regulated constructs compared to the constitutive construct (OT-L15-008) in the absence of the ligand. Destabilization ratios less than 1 and stabilization ratios greater than 1 are desired in DDs.

TABLE 92

| TMP dose response | | | | | | |
|---|---|---|---|---|---|---|
| TMP | | | OT-IL15-009 | | Stabilization | Destabilization |
| (hours) | Untransduced | OT-IL15-008 | DMSO | TMP | Ratio | ratio |
| 1 | 1.26 | 27.96 | 2.03 | 1.86 | 0.92 | 0.07 |
| 2 | 1.25 | 28.10 | 2.12 | 2.27 | 1.07 | 0.08 |
| 4 | 1.14 | 27.76 | 1.99 | 4.01 | 2.02 | 0.07 |
| 6 | 1.18 | 28.14 | 1.87 | 5.85 | 3.13 | 0.07 |
| 8 | 1.05 | 28.21 | 2.14 | 7.09 | 3.31 | 0.08 |
| 15 | 1.37 | 29.15 | 2.46 | 12.53 | 5.09 | 0.08 |
| 22 | 1.20 | 29.15 | 2.78 | 14.57 | 5.24 | 0.10 |
| 24 | 1.35 | 29.70 | 2.07 | 13.75 | 6.64 | 0.07 |

Among the CD4 positive T cells transduced with the OT-IL15-009 construct, the proportion of cells with surface expression of IL 5Ra remained similar for both TMP treated and DMSO treated cells until 2 hrs after TMP treatment, and was comparable to that of untransduced cells. However, 4 hrs after TMP treatment, the cells transduced with the OT-IL15-009 construct and treated with TMP exhibited an increased proportion of cells with surface expression of IL15Rα. This trend was observed until 22 hours after treatment with TMP. The CD4 positive T cells with surface-expressed IL 15Ra cells constituted ~1% of untransduced cells, indicating that the proportion of cells that expressed endogenous IL15Ra is low. In summary, the stabilization ratio showed a time dependent increase while the destabilization ratio remained at or below 0.1 reflecting low basal expression, reflecting the tunability of the DD regulated IL15 construct.

Example 85. IL12 Expression In Vivo

Figure 56:
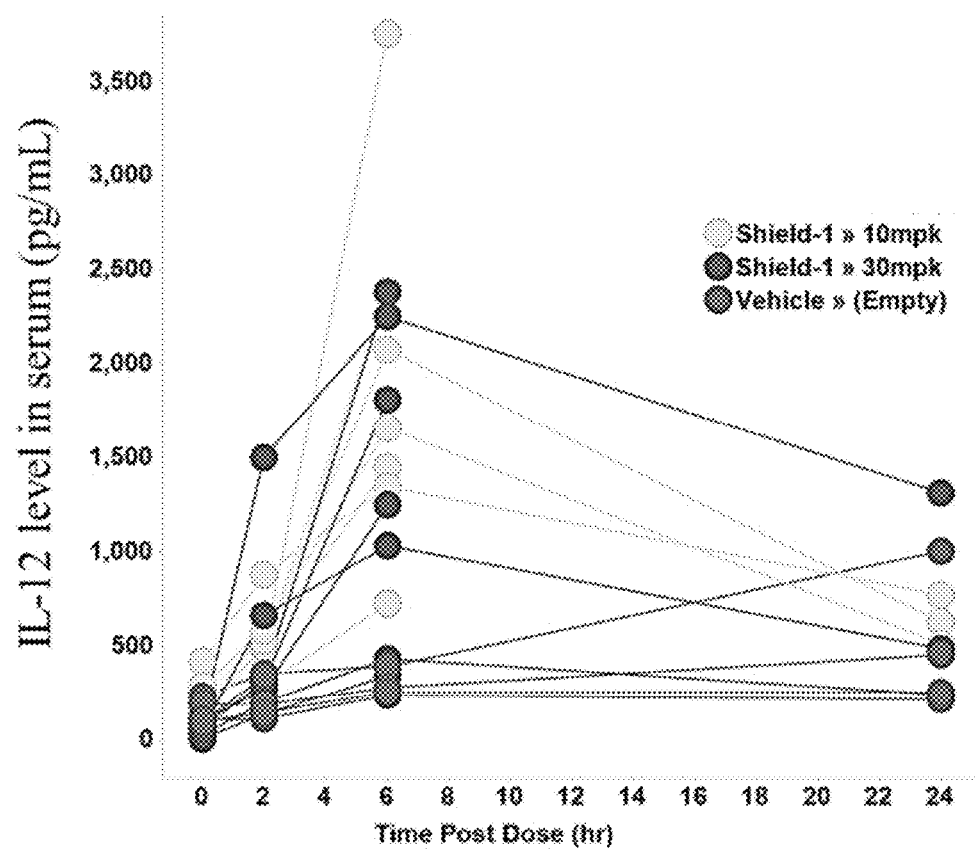
FIG. 56 depicts plasma IL12 levels in mice in response to different Shield-1 dosing regimens.

SKOV3 tumor cells expressing FKBP regulated-IL12 (#OT-IL12-009) or parental cells were implanted into SCID Beige mice (Day 0). Mice implanted with FKBP IL12 were dosed intraperitoneally with Shield-1 (10 mg/kg or 30 mg/kg) or vehicle control on Day 43. Blood samples were collected prior to dosing (0 hour) as well as at 2, 6, and 24 hours after Shield-1 dosing and serum human IL12 levels were measured using ELISA. The serum IL12 concentrations are presented in FIG. 56. IL12 levels increased in Shield-1 treated mice at 2 and 4 hours after treatment, compared with those at 0 hours. By 24 hours following treatment, the IL12 levels returned levels observed at 0 hours. The increase in IL2 at 2 and 4 hours after treatment was observed with both doses of Shield-1. IL12 levels in vehicle control treated mice was generally lower than those in the Shield-1 treated mice.

Example 86. Promoter Selection for Expression of IL12 Constructs

Figure 57A:
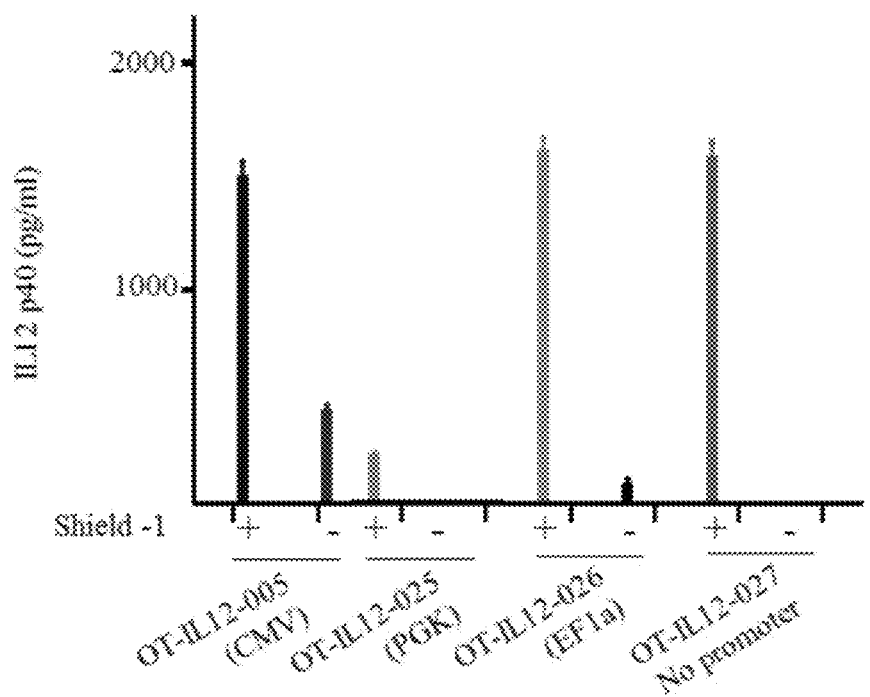
FIG. 57A-FIG. 57E depict promoter and cell type effects on expression of IL12 constructs.
Figure 57B:
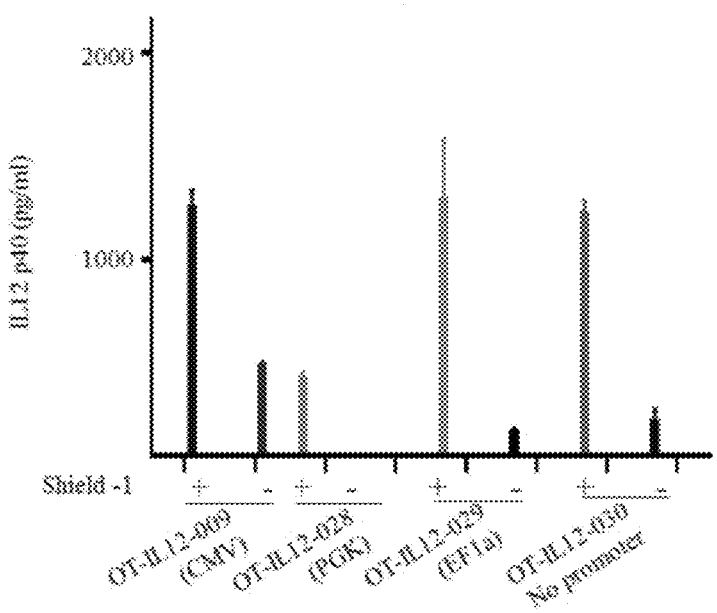

The expression of SREs in a vector can be driven by either the retroviral long terminal repeat (LTR) or by cellular or viral promoters located upstream of the SRE. The activity of the promoter may vary with the cell type and thus promoter selection must be optimized for each cell type. To identify optimal promoters, IL12 fused to FKBP DD and an optional furin cleavage site was cloned into pLVX. IRES Puro vector and placed under the transcriptional control of a CMV promoter (OT-IL12-005, OT-IL12-009), a PGK promoter (OT-IL12-025, OT-IL028), an EF1a promoter (OT-IL12-020, OT-IL12-026, OT-IL12-029), or without a promoter (OT-IL12-027, OT-IL12-030). Constructs were transiently transfected into HEK293T cells and cells were treated with Shield-1 for 24 hours. IL12 levels in the supernatant were measured using p40 ELISA and MSD immunoassay. As shown in FIG. 57A and FIG. 57B, among the IL12 constructs, expression of IL12 in the absence of Shield-1 was very low to undetectable when the PGK, EF1a or no promoter was utilized. In contrast, IL12 expression under the CMV promoter was detectable even in the absence of Shield-1 suggesting that the CMV promoter is leaky. IL12 levels were increased with shield-1 treatment with all constructs. The PGK promoter showed the smallest induction of IL12 with ligand treatment compared to other promoters.

Figure 57C:
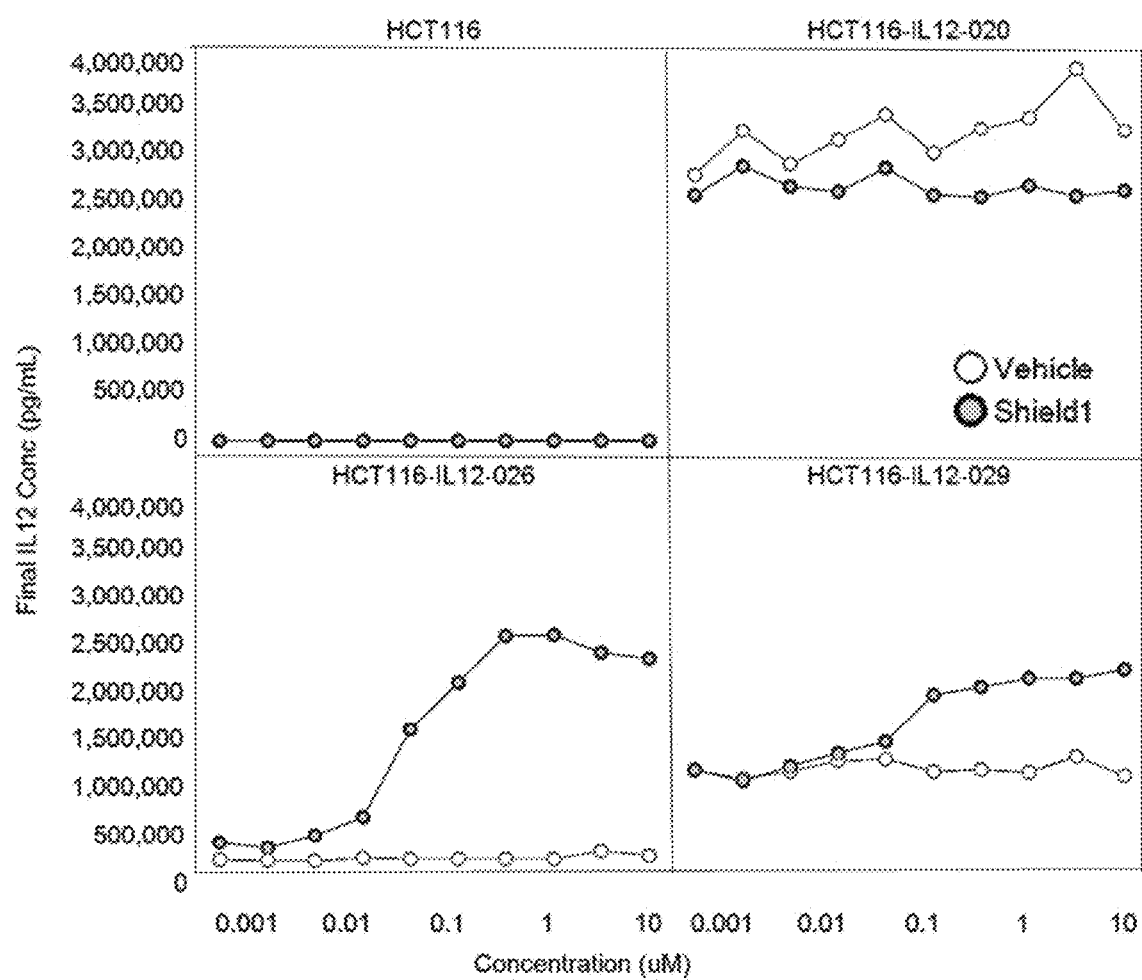
Figure 57D:
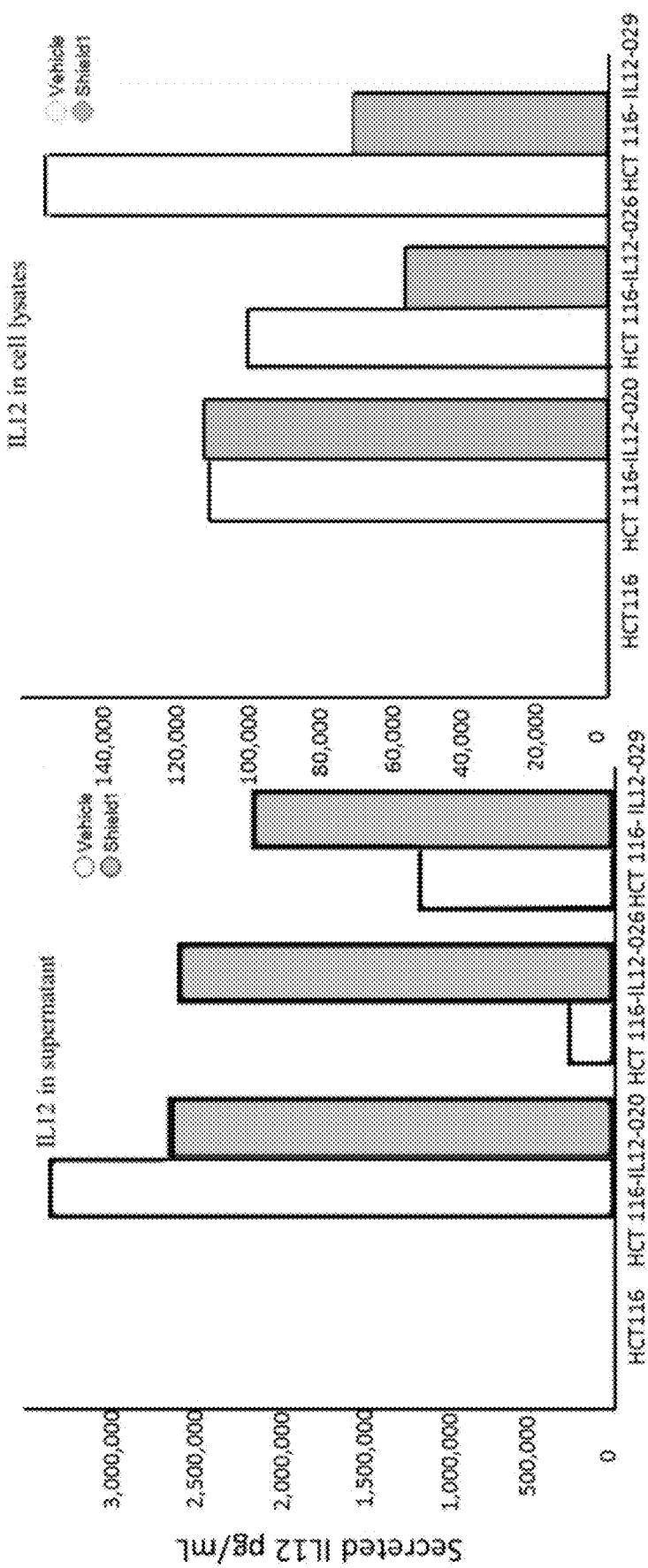

IL12 constructs were also tested in HCT 116 cells and Raji cells over a range of shield-1 doses. IL12 constructs driven by the EF1a promoter were transfected into HCT116 cells. Cells were incubated for 24 hours and then treated with Shield-1 for another 24 hours. Secreted IL12 levels were then measured. As shown in FIG. 57C, IL2 expression in HCT cells expressing OT-IL12-026 (EF1a) construct increased with increasing doses of Shield-1 while the expression of IL2 was undetectable with vehicle control. OT-IL12-029 showed similar increase in IL2 expression with Shield-1 expression, however, the levels of IL12 obtained with vehicle control treatment were comparable to shield-1 treated cells. As expected the constitutive construct showed high levels of IL2 both in the presence and absence of Shield-1, while the parental HCT116 cells did not secrete any IL12. Intracellular IL2 levels in HCT116 cells were compared with secreted IL2 levels. Cells were dosed with 1i M Shield-1 for 24 hours and IL12 were measured in the supernatant and within cells using MSD immunoassay. As shown in FIG. 57D, secreted IL2 levels with the OT-IL12-026 and 029 construct was increased with Shield-1 treatment as compared to the vehicle control. However, intracellular concentration of IL12 did not increase with both constructs in Shield-1 treated cells. The intracellular concentrations of IL12 were also 10-fold lower than secreted IL12 levels. These data suggest that Shield-1 may be increasing the secretion of IL12 into the media.

Figure 57E:
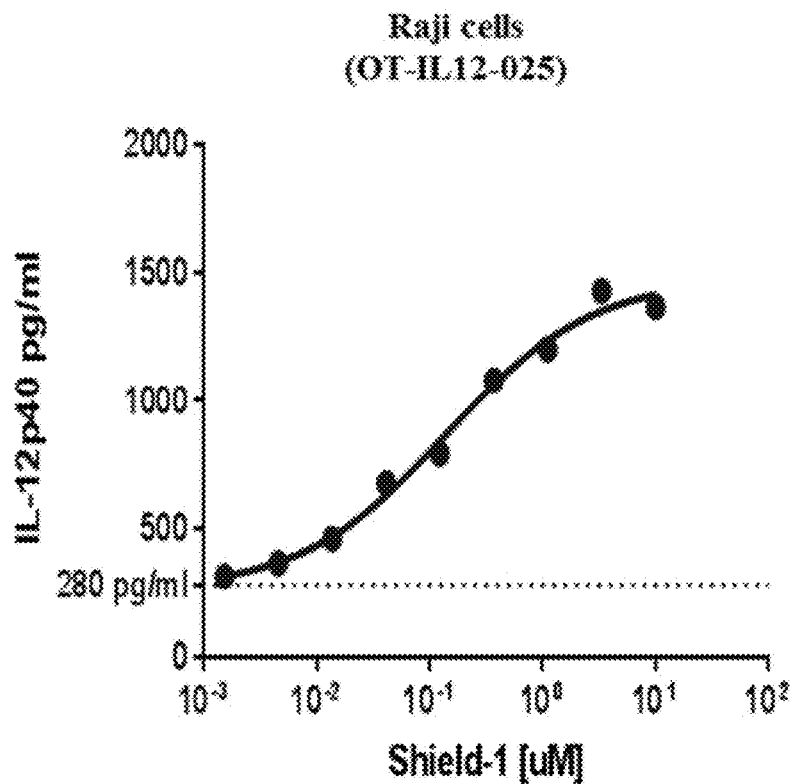

A Shield-1 dose responsive increase in secreted IL12 levels was observed with the expression of OT-IL12-025 (PGK) in Raji cells (FIG. 57E). Taken together, these results indicate that transcriptional control of IL 12 by EF1a, or no promoter results in low basal expression in the absence of ligand and strong ligand dependent expression. In contrast, the CMV promoter results in high basal expression while only low levels of IL12 are detected with PGK promoter.

Example 87. IL12 Expression In Vivo: HCT116 Tumor Study

The HCT116 tumor study is established to correlate tumor size with serum IL12 levels before and after dosing with ligands such as Aqua Shield. DD regulated or constitutive constructs are transduced into HCT116 cells and the cells are injected subcutaneously at 10 million per injection into the flanks of CD-1 nude mice, and SCID beige mice. Mice are allowed to develop tumors that are approximately 200-300 mm$^3$ in size and then dosed with ligands. For example, Shield-1 is dosed orally at 50 mg/kg or vehicle control. The frequency of dosing is varied to identify the optimal dosage and frequency of dosage. Blood samples are collected prior to shield-1 dosing as well as 2, 4, 6 and 24 hours after dosing. Plasma IL12 levels are measured and correlated with tumor volume. When the tumors reach approximately 1000 mm$^3$, mice are sacked and plasma, tumor and kidney samples are collected. Tumor growth is expected to correlate with plasma IL12 levels such that larger tumors secrete more IL12.

Example 88. Ligand Regulated Expression of IL12 in T Cells

T cells from human donors were thawed on day zero and stimulated with αCD3/αCD28 beads. On day one, cells were transduced with either DD regulated IL12 constructs, OT-IL12-026 and OT-IL12-029; or were left untransduced. The puro titer of the OT-IL12-026 and OT-IL12-029 were 6e$^7$ TU/mL and 5e$^7$ TU/mL respectively. Cells were allowed to recover and then treated with Shield-1 for 48 hours. IL12 levels were measured in the supernatant using an immunoassay, MSD assay. The results are shown in Table 93.

TABLE 93

| | IL12 levels in T cells | | |
|---|---|---|---|
| Treatment | Control | OT-IL12-026 | OT-IL12-029 |
| Vehicle | 0 | 17 | 24 |
| Shield-1 1 µM | 1 | 854 | 530 |

As shown in Table 93, IL12 levels were increased 50-fold in OT-IL12-026, the construct without a cleavable linker and increased 22-fold in OT-IL12-029, the construct with the cleavable furin linker. As expected, no IL12 expression was seen in the untransduced parental T cells. Taken together, these data demonstrate that IL12 secretion can be induced in T cells transduced with DD regulated IL12 and can be regulated by the addition of ligand.

Example 89. Kinetic and Concentration-Dependent Regulation of IL12 in Human T Cells On day 0, the human donor T cells were thawed and cultured in the presence of IL2 and CD3/CD28 beads. On day 1, cells were transduced with lentivirus for construct OT-IL12-026 at MOIs of 40, 13.3 or 4.4. 24 hours following the transduction, the media was replaced with fresh media containing CD3/CD28 beads and IL2. On day 13, the cells were debeaded by centrifuging cells and resuspending the cell pellet in media with IL2. Cells were then plated at 100,000 per well on U-bottom 96-well plate. On day 14, cells were treated for 24 hours with varying concentrations of Shield-1 or vehicle control. On day 15, the supernatant was harvested and IL12 p40 levels were measured by MSD assay. The results are shown in Table 94. In the Table 94, MOI stands for multiplicity of infection.

TABLE 94

IL12 levels in T cells

| Shield-1 (nM) | MOI = 4.4 | MOI = 13.3 | MOI = 40 |
| --- | --- | --- | --- |
| 0.1 | 49.44 | 48.10 | 88.30 |
| 1 | 50.44 | 48.61 | 80.07 |
| 5 | 50.44 | 49.54 | 88.83 |
| 10 | 178.18 | 220.08 | 374.90 |
| 50 | 357.11 | 420.72 | 608.85 |
| 100 | 710.56 | 972.56 | 1293.01 |
| 500 | 1284.95 | 1307.70 | 1861.36 |
| 1000 | 1152.28 | 1559.43 | 2346.15 |
| 2000 | 1071.54 | 1577.99 | 2330.88 |

As shown in Table 94, all three MOIs showed a Shield-1 dose dependent increase in IL12 levels. Additionally, IL12 levels secreted by T cells was also proportionate to the MOI, with the higher MOI showing the highest IL12 levels for any given concentration of Shield-1 treatment. The dose response curve was similarly shaped for all three doses was similar, but the absolute values were different for each dose. At higher concentrations of Shield-1, i.e. greater than 5 µM, viability was reduced as cells started to die likely due to the high concentration of vehicle. The $EC_{50}$ which is the half effective dose of Shield-1 for each MOI is show in Table 95.

TABLE 95

Shield-1 $EC_{50}$ in T cells

| MOI | EC50 (nM) |
| --- | --- |
| 40 | 130 |
| 13.3 | 94 |
| 4.4 | 84 |

A time course experiment was also performed using Shield-1 at a dose of 1 µM. T cells transduced with OT-IL12-020, OT-IL12-026 or empty vector were treated with Shield-1 or vehicle control for 4, 8, 16 and 24 hours. IL12 p40 levels were measured using MSD assay. The results are shown in Table 96. The stabilization ratio was measured as the ratio of expression of IL12 in the presence of the stimulus to the expression in the absence of the stimulus.

TABLE 96

Time course of IL12 expression

| Time (Hours) | Vector | OT-IL12-020 | OT-IL12-026 | | |
| --- | --- | --- | --- | --- | --- |
| | | | Vehicle | Shield-1 | Stabilization ratio |
| 4 | 0.20 | 2171.42 | 120.00 | 311.28 | — |
| 8 | 0.11 | 2090.96 | 81.82 | 499.45 | 6.10 |
| 16 | 0.27 | 1657.67 | 28.80 | 1070.71 | 37.17 |
| 24 | 0.23 | 2198.52 | 100.11 | 1447.78 | 14.46 |

As shown in Table 96, OT-IL12-026 construct showed an increase in IL12 levels over the course of time, when compared to cells treated with vehicle control. At 4 hours after treatment, the stabilization ratio IL12 levels were increased 2.7-fold compared to vehicle, at 8 hours IL12 levels increased by 6-fold; at 16 hours, the levels increased by 35-fold, and by 24 hours the IL12 levels increased to 14-fold compared to vehicle control. The constitutive construct OT-IL12-020, showed consistently high expression of IL12. A decrease in the expression of the constitutive construct was observed at 16 hours. However, the levels of IL12 were still much higher than OT-IL12-026, both in the presence or absence of Shield-1. As expected the vehicle control showed little to no expression of IL12. Taken together, these data demonstrate the kinetic regulation of DD-IL12 secretion in T cells with fine-tuned control compared to the elevated levels of constitutive IL12 secretion.

In another study, it was shown that CD8 cells expand more than CD4 cells, and that T cells (especially the CD8+ subset) lose IL12 expression during expansion. Restimulation of the cells with CD3/CD28 beads at day 14 increased the frequency and expression level of IL12 as compared to cells at day 14 that had not been restimulated.

To further evaluate restimulation, OT-IL12-020, OT-IL12-026, vehicle only and empty vectors were tested in T cells at day 0, 7 and 14 post transduction. The CD8+ subset increased over time in vitro, the frequency of IL12p70+ T cells decreased over time in culture but IL12 can be reinduced with CD3/CD28 and were shown to increase with restimulation on day 14. Shield-1 was found to increase production of IL12, but not IFNγ, by T cells in vitro on Day 15 post transduction. In this study, basal levels of DD-IL12 were sufficient (remained above the EC50 for Th1 differentiations) to skew non-transduced cells towards a Th1 phenotype during in vitro T cell expansion.

Example 90. In Vivo Regulation of DD-IL12 in T Cells

T cells were activated, transduced with OT-IL12-020, OT-IL12-026 or empty vector and expanded over a period of 10 days as discussed in Example 28. On day 0 of the assay, T cells were injected in vivo into NSG mice, following which Aquashield was injected into mice. On day 3, Aquashield was injected at a dose of 100 mg/kg. Prior to the Aquashield injection, a blood sample was collected from the mice and served as the 0-hour time point or as the untreated control. A repeat dose of 100 mg/kg was administered at 4 hours following the first dose. Blood samples were collected from mice at 4, 8, 12 and 24 hours following the initial dose. Plasma IL12 levels were measured using MSD assay and the results are shown in Table 97.

TABLE 97

IL12 levels in T cells in vivo

| Construct | Time (hours) | Vehicle | Aquashield |
|---|---|---|---|
| Empty Vector | 0 | 1.00 | — |
| Empty Vector | 24 | 1.00 | — |
| OT-IL12-020 | 0 | 298221.91 | — |
| OT-IL12-020 | 24 | 268743.49 | — |
| OT-IL12-026 | 0 | 1070.18 | 885.41 |
| OT-IL12-026 | 4 | 1108.22 | 20141.45 |
| OT-IL12-026 | 8 | 1195.68 | 32287.39 |
| OT-IL12-026 | 12 | 1026.01 | 30137.85 |
| OT-IL12-026 | 24 | 1032.65 | 7903.30 |

As shown in Table 97, plasma IL12 levels for OT-IL12-026 were much higher at 4 hours following first dose and peaked at 8 hours, following which, they decreased at 12 hours and decreased even further at 24 hours. Virtually no IL12 was detected in the plasma of vehicle control treated mice suggesting low basal expression of the construct. These observations were also reflected in the destabilization ratio of OT-IL12-026, which was 0.0035, indicating strong destabilization in the absence of ligand and stabilization ratios of 18.17, 27, 29.37 and 7.65 respectively for 4, 8, 12 and 24 hours of Shield-1 treatment of OT-IL12-026 expressing cells. The stabilization ratio was measured as the ratio of expression of IL12 in the presence of the stimulus to the expression in the absence of the stimulus. The destabilization ratio was measured as the ratio of expression of IL12 in the absence of the shield-1 to the expression of IL12 that is expressed constitutively. As expected, plasma of mice injected with T cells expressing the constitutive construct showed high IL12 expression both at 0 and 24 hours, while no IL12 was detected in the plasma of mice injected with T cells expressing empty vector.

IL12 levels in response to varying doses of Aquashield was also tested in vivo. 3 days after injecting 25 million T cells transduced with OT-IL12-026, NSG mice (n=4) were dosed orally with Aquashield at 50 or 100 mg/kg at 0 and 48 hours. Blood samples were collected at 0, 4, 8 and 24 hours after the first dosing. The mice were allowed to rest for 24 hours, following which, they were dosed with Aquashield again (i.e. at 48 hours since the initial dose) and blood samples were collected at time points identical to the first dose. Plasma IL12 levels were measured using p70 MSD assay. The results are shown in Table 98. The stabilization ratio was measured as the ratio of expression of IL12 in the presence of the stimulus to the expression in the absence of the stimulus. The destabilization ratio was measured as the ratio of expression of IL12 in the absence of the shield-1 to the expression of IL12 that is expressed constitutively.

TABLE 98

Shield-1 dose response

| | | 50 mg/kg Aquashield | | 100 mg/kg Aquashield | |
|---|---|---|---|---|---|
| Time (hours) | Vehicle | IL12 (pg/ml) | Stabilization ratio | IL12 (pg/ml) | Stabilization ratio |
| 0 | 3.97 | 4.27 | — | 4.74 | — |
| 4 | 1.66 | 85.83 | 51.73 | 130.53 | 78.68 |
| 8 | 1.40 | 54.96 | 33.12 | 157.88 | 95.16 |
| 24 | 1.39 | 4.45 | 2.68 | 9.98 | 6.01 |
| 48 | 1.72 | 2.93 | 1.76 | 3.50 | 2.11 |
| 52 | 1.82 | 60.27 | 36.32 | 91.37 | 55.07 |
| 56 | 0.95 | 43.71 | 26.35 | 106.09 | 63.94 |
| 72 | 1.01 | 3.84 | 2.32 | 6.53 | 3.93 |

Similar to the single dosing experiments, described in table 98, mice treated with 100 mg/kg showed peak plasma IL12 in Aquashield treated mice at 8 hours and declined by 24 hours, reaching levels comparable to the IL12 levels at 0 hours, and remained low at 48 hours. 4 hours after the second dose, IL12 levels began to increase, reaching a peak level at 8 hours following the second dose and reached baseline levels by 24 hours after the second dose e.g., 72 hours after the initial dose. Mice treated with the 50 mg/kg Aquashield showed peak plasma IL12 at 4 hours after dosage, which continued to decline at subsequent time points tested. These trends were also reflected in the stabilization ratios calculated for each of the time points with both doses. With higher dose of Shield-1, higher stabilization ratios were observed at each time point suggesting the dose responsive elevation in IL12 levels. The destabilization ratios were also measured at both doses of Shield-1 by injecting a small cohort of mice with T cells expressing the constitutive construct, OT-IL12-020. At time point zero, the stabilization ratio for 50 and 100 mpk was 0.004 for both doses, suggesting low basal expression in the absence of ligand. These data also suggest that it is possible to restimulated the T cells transplanted into mice to produce IL12. Additionally, IFNγ was produced in the basal state and it was upregulated concurrent with IL12.

An additional cohort dosed at 10 mg/kg was also included to fully define the dose response curve. These results are shown in Table 99.

TABLE 99

IL12 response to second dose of Shield-1

| | | 10 mg/kg Aquashield | | 50 mg/kg Aquashield | | 100 mg/kg Aquashield | |
|---|---|---|---|---|---|---|---|
| Time (hours) | Vehicle | IL12 (pg/ml) | Stabilization ratio | IL12 (pg/ml) | Stabilization ratio | IL12 (pg/ml) | Stabilization ratio |
| 0 | 1.72 | 2.79 | — | 2.93 | — | 3.50 | — |
| 4 | 1.82 | 8.13 | 4.48 | 60.27 | 33.20 | 91.37 | 50.34 |
| 8 | 0.95 | 4.35 | 2.40 | 43.71 | 24.08 | 106.09 | 58.45 |
| 24 | 1.01 | 1.52 | 0.84 | 3.84 | 2.12 | 6.53 | 3.60 |

Compared to the 50 and 100 mg/kg doses, the 10 mg/kg dose showed very little IL12 expression that was comparable to the expression observed with the vehicle control treatment. A small increase in IL12 levels was observed at 4 hours with the 10 mg/kg dose, but the stabilization ratio observed at this time point was much lower than observed with the 50 and 100 mpk doses. Taken together, these data demonstrate that in vivo repeat dosing of the ligand, Aquashield results in a dose dependent increase in IL12 levels. The lack of IL12 in the plasma at 24 hours after dosing indicates that IL12 is cleared from the plasma by this time point resulting in distinct peaks of circulating IL12.

Example 91. DD Regulated Recombinant IL2 Expression

FKBP (L106P) and ecDHFR (R12Y, Y100I) are well-characterized destabilizing domains which can confer instability to fusion partners (e.g., a POI). The instability is reversed by a synthetic ligand named Shield-1 that binds to FKBP DDs and TMP or MTX that binds to DHFR DD. An IL2 polypeptide was linked to either FKBP (F36V; L106P) or ecDHFR (R12Y, Y100I). IL2 constructs were packaged into pLVX-IRES-Puro lentiviral vectors. An IL2 signal sequence was inserted at the N terminus of the construct and linkers were placed between the signal sequence, the DD and IL2.

Figure 58:
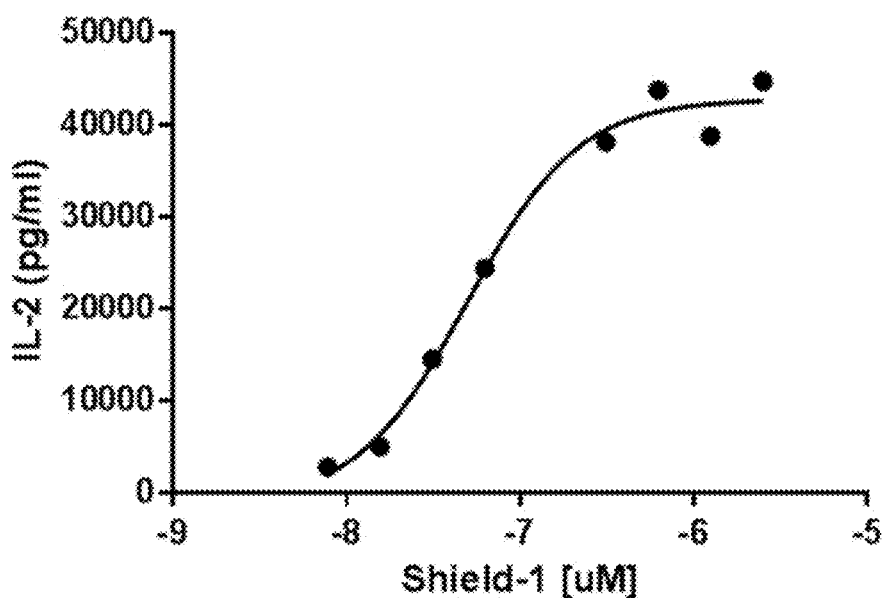
FIG. 58 is a line graph depicting the effect of Shield-1 on DD-L2 levels.

OT-IL2-001 (FKBP) was transduced into human colorectal carcinoma line, HCT-116. To measure the dependence of IL2 levels on Shield-1 dose, cells were plated onto a 96 well plate and treated with varying concentrations of Shield-1. Media was then collected from cells and IL2 levels were quantified using IL2 ELISA (FIG. 58). IL2 increased with increase in Shield-1 concentration and plateaued at higher Shield-1 dose levels. The half maximal effective concentration or $EC_{50}$ of Shield-1 was determined to be 50 nM.

Example 92. DD Regulated Luciferase

A luciferase polypeptide was linked to either FKBP (F36V, L106P or F36V, E31G, R71G, K105E) or ecDHFR (R12Y, Y100I) and cloned into pLVX.IRES. Puro vector.

Figure 59A:
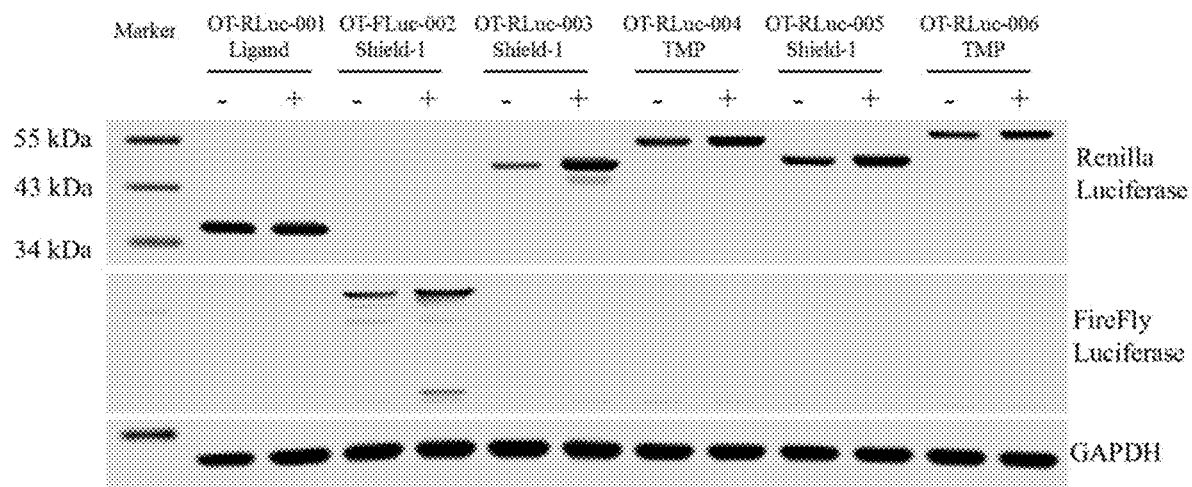
FIG. 59A-FIG. 59B show DD regulated luciferase expression and activity.

DD regulated luciferase can be used to track cells in vivo e.g. T cells. Firefly luciferase or *Renilla* luciferase may be utilized as the payload. HCT-116 cells were stably transduced with the constitutive (OT-RLuc-001) or DD regulated constructs (OT-RLuc-002, OT-RLuc-003, OT-RLuc-004, OT-RLuc-005 and OT-RLuc-006). Cells were treated with 1 µM Shield-1, 10 µM Trimethoprim or vehicle control for 24 hours and luciferase expression was measured via western blotting using anti-*Renilla* luciferase and anti-Firefly luciferase antibodies (Abcam, Cambridge, UK). Blots were also probed with anti-GAPDH antibody to ensure uniform protein loading in all samples. As shown in FIG. 59A, OT-RLuc-003 showed strong Shield-1 dependent stabilization of *Renilla* luciferase. OT-RLuc-004, 005 and 006 showed modest stabilization of *Renilla* luciferase in the presence of their corresponding ligand, while OT-FLuc-002 showed modest stabilization of firefly luciferase with the addition of Shield-1. As expected, the constitutive luciferase construct (OT-RLuc-001) showed expression of *Renilla* luciferase both in the presence and absence of ligand. (FIG. 59A).

Figure 59B:
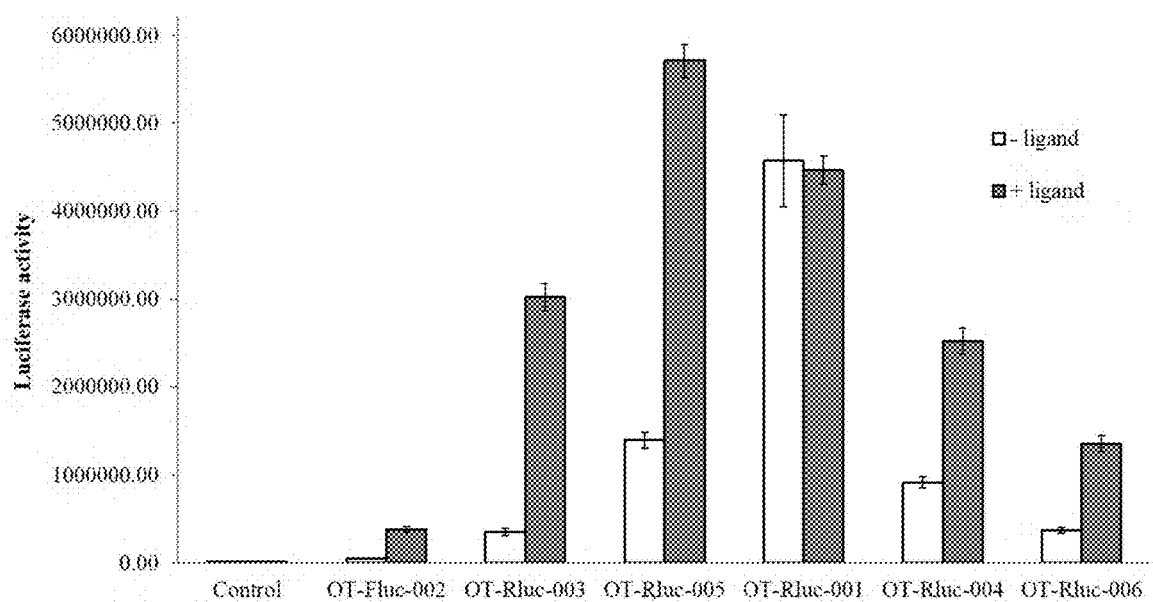

Ligand dependent activity of *Renilla* and firefly luciferase constructs was measured using coelentrazine and luciferin substrates respectively. Cells were treated with 1 µM Shield-1, 10 µM Trimethoprim, or vehicle control for 24 hours, lysed with assay lysis buffer and incubated with the luciferase substrate. Luciferase activity was measured as luminescence reading using a luminometer and the values were compared to control samples consisting of lysis buffer and substrate. All DD regulated showed ligand dependent increase in luciferase activity compared to control. As expected, the constitutive construct OT-RLuc-001 showed high luciferase activity both in the presence and absence of ligand (FIG. 59B).

Example 93. DD Regulated IL2 and IL2 Mediated Functions

DD-IL2 function is characterized in vivo by evaluating the ability of tumor cells expressing these constructs to establish tumors and proliferate under the treatment of corresponding synthetic ligands e.g. Shield-1, Trimethoprim or Methotrexate. 2-10 million HCT-116 cells stably transduced with the constructs are subcutaneously xenografted with matrigel into mice that capable of producing functional B and NK cells. Approximately, two weeks after injection, when the tumors reach a size of approximately 300 cubic mm, mice are dosed with corresponding stabilizing ligands e.g. Shield-1, Trimethoprim or Methotrexate at varying concentrations every two days. Shield-1 is injected with a carrier consisting of 10% Dimethylacetamide, 10% Solutol HS15, and 80% saline. Tumor volume and body weight are monitored twice a week and the experiment is terminated once the tumors reach 1000 cubic mm in size. Plasma and tumor samples are collected 8 hours after the last dose of the ligand and IL2 as well as the ligand levels are measured.

To evaluate the ability of IL2 expressing cells to form tumors, HCT-116 cells stably transduced with DD-IL2 constructs are pretreated with corresponding stabilizing ligands, Shield-1, Trimethoprim or Methotrexate and subsequently xenografted into mice. Reduction in tumor growth and a concomitant increase in IL2 levels in ligand treated mice compared to untreated controls is indicative conditional regulation of IL2 in vivo.

Example 94. In Vivo Tracking of DD Luciferase Cells

DD luciferase constructs can be utilized as an optical reporter to asses if the ligand and/or the cells expressing the DD constructs reach the targeted tissue. It may also be utilized to study pharmacokinetic and pharmacodynamic (PK/PD) relationships in the context of DD. PK/PD depends on (i) the PK of the stabilizing ligand (ii) behavior of the DD in a specific cell type (iii) cargo protein behavior; some of which may be studied by utilizing the DD regulated luciferase constructs. DD luciferase constructs are expressed or co-expressed in cells of interest such as primary T cells or cell lines e.g. HCT-116, SKOV-3 cells and injected into immune compromised mice e.g. via tail vein, intra peritoneal, or subcutaneous injections. Mice are treated with the corresponding ligand or vehicle control. 8-24 hours following ligand injection, mice are injected with D-Luciferin when the payload is firefly luciferase and Coelentrazin when the payload is *Renilla* luciferase. Animals are anesthetized and imaged using the Bioluminescence imager (PerkinElmer, Mass.). The luciferase output of ligand injected mice is compared to control mice and the signal is quantitated using image analysis software (PerkinElmer, Mass.). Luciferase signal is expected to be much higher than background in mice treated with ligand compared to mice treated with vehicle control.

Example 95. DD Regulated FOXP3 Expression

A fusion molecule is generated by fusing full length or truncated (FOXP3A2) and DDs such as ecDHFR (DD) or FKBP (DD). These fusion molecules were cloned into pLVX-IRES-Puro vectors.

Figure 60A:
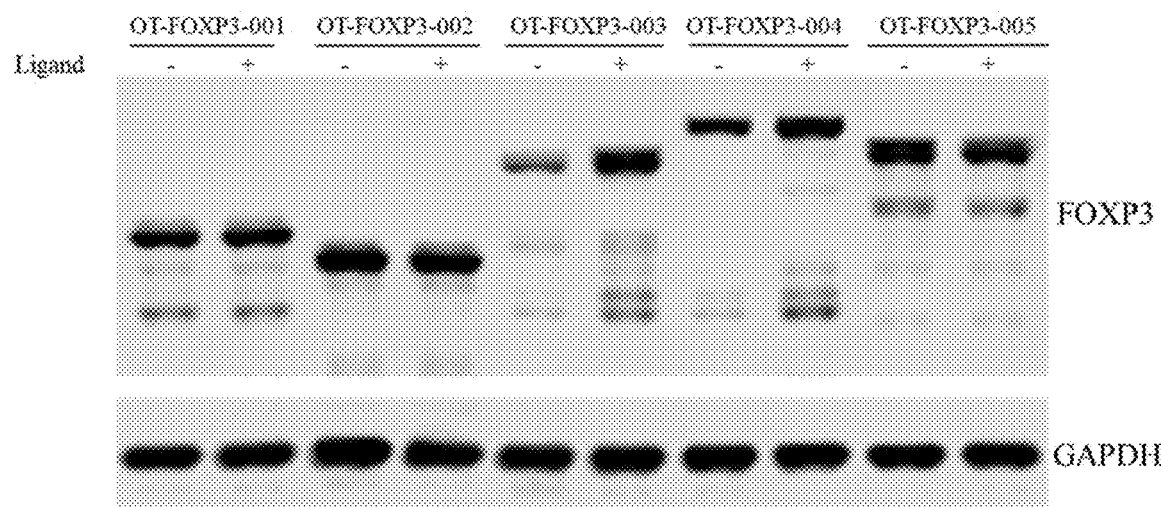
FIG. 60A-FIG. 60B show DD regulated FOXP3 expression.
Figure 60B:
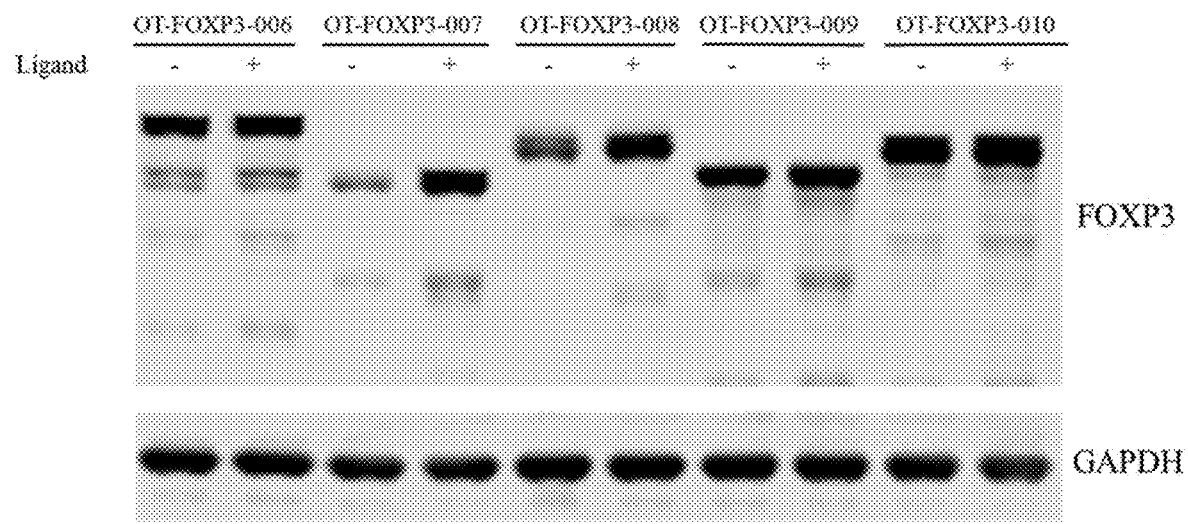

To test ligand dependent FOXP3 production, 1 million HEK-293T cells were plated in a 6-well plate in growth media containing DMEM and 10% FBS and incubated overnight at 37° C., 5% CO2. Cells were transfected with the constructs using Lipofectamine 2000 and incubated for 24 hrs. Following the incubation, media was exchanged for growth medium with or without 10 µM Trimethoprim or 1 µM Shield-1 and further incubated for 24 hrs. Cells were harvested and FOXP3 levels were analyzed via western blotting using anti FOXP3 antibody (Abcam, Cambridge, UK). OT-FOXP3-003, and OT-FOXP3-007 showed the strongest Shield-1 dependent stabilization of FOXP3, while OT-FOXP3-008 showed the strongest Trimethoprim dependent stabilization of FOXP3 (FIG. 60A and FIG. 60B). Constructs OT-FOXP3-004 and OT-FOXP3-009 showed modest TMP and shield-1 dependent stabilization.

Example 96. Ligand Dependent IL2 Stabilization In Vivo

An IL2 polypeptide was linked to either FKBP (F36V; L106P) or ecDHFR (R12Y, Y100I). IL2 constructs were packaged into pLVX-IRES-Puro lentiviral vectors. An IL2 signal sequence was inserted at the N terminus of the construct and linkers were placed between the signal sequence, the DD and IL2.

Figure 61:
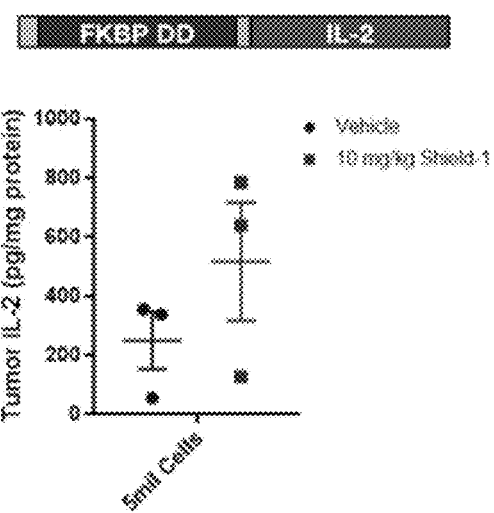
FIG. 61 represents Shield-1 regulation of DD-IL2 secretion from HCT116 cells in vivo.

OT-IL2-001 (FKBP) was transduced into human colorectal carcinoma line, HCT-116. IL2 expression in vitro was confirmed by ELISA. To test in vivo ligand mediated regulation, 5 million HCT 116 cells transduced with IL2 constructs were injected subcutaneously into the flanks of immunocompromised mice. Approximately, two weeks after injection, when the tumors reach a size of approximately 300 cubic mm, mice are dosed with corresponding stabilizing ligands or corresponding vehicle control. Shield-1 is injected with a carrier consisting of 10% Dimethylacetamide, 10% Solutol HS15, and 80% saline at a concentration of 10 mg/kg body weight. Mice were euthanized at tumor and plasma samples were collected and analyzed for IL2 levels. Tumor IL2 levels were measured by ELISA as picograms per mg of protein. As shown in FIG. 61, tumor IL2 levels detected with Shield-1 treatment was higher than levels detected with vehicle control. These data demonstrate a dose dependent L2 secretion from HCT116 cells stably expressing FKP-IL2 in vivo.

Example 97. Optimization of T Cell Transduction and Expansion

Figure 62:
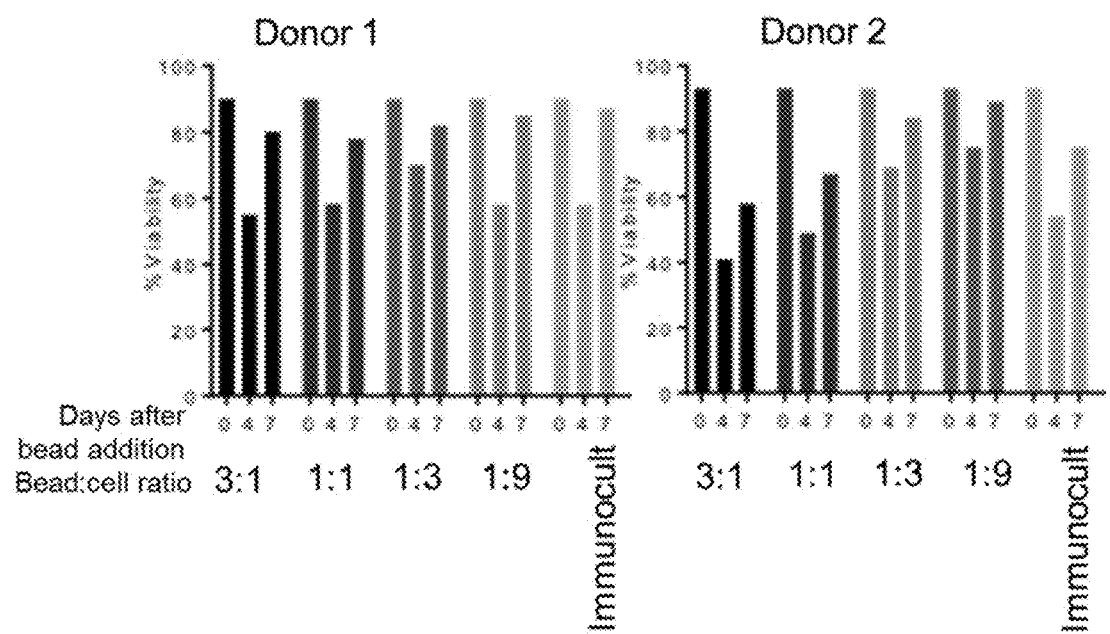
FIG. 62 depicts the viability of T cells cultured with different ratios of CD3/CD8 beads.

The T cell expansion and transduction protocol consists of stimulating donor derived human T cells on day zero with aCD3/aCD28 bead stimulation to promote T cell proliferation. On day one, T cells were transduced with the construct of choice and expanded for up to day 11 with occasional media changes. On day 11, the beads were washed out and the cells were frozen in aliquots for use in various functional assays. The process of T cell expansion and transduction requires optimization to ensure the exponential proliferation of T cells, following the initial 4-day lag in growth of the T cells which is caused by the viral transduction. Unoptimized expansion protocol may result in static growth for up to 10 days requiring instead 21 days to achieve similar expected T cell number and a concomitant reduction in viability and abnormal CD4 to CD8 T cell ratio. The source of αCD3/αCD28 used for T cell stimulation and the ratio of the beads were tested to identify optimal conditions. αCD3/αCD28 beads from different sources were utilized. These included dynabeads (ThermoFisher, Waltham, Mass.), CD3/CD28+/−CD2 with anti-Biotin MACSiBead (Miltenyi Biotec, Germany), Macrobeads~3 µm magnetic polymer beads with αCD3/αCD28 antibody coating, soluble tetrameric antibody complexes of αCD3/αCD28 (StemCell, Canada). Bead and T cells were mixed at 3:1, 1:1, 1:3 and 1:9 ratios to identify optimal ratios for co-culture. Assays were also performed using two separate donors to account for donor related variabilities. Percentage cell viability was measured at 0, 4 and 7 days. As shown in FIG. 62, both donors showed improved cell viability counts at 1:3 bead to cell ratio compared to all other conditions, especially at day 4. One of the donors also showed improved cell viability at with 1:9 bead to cell ratio. Cell number counts were performed using both the cellometer and flow cytometry analysis. For this analysis, cells were infected with viruses at MOI of 10 and compared to mock (Lentiboost (LB) transduced cells to examine the effects of viral transduction on T cell counts. The fold change in cell growth at day 4 and day 7 compared to growth at day 0 was analyzed and the results from the cellometer counts are represented in Table 100.

TABLE 100

| | T cell proliferation | | | |
|---|---|---|---|---|
| Experimental | Donor1 | | Donor 2 | |
| condition | Day 4 | Day 7 | Day 4 | Day 7 |
| MOI 3:1 | 1.70 | 5.00 | 1.94 | 3.90 |
| MOI 1:1 | 2.15 | 3.95 | 2.55 | 4.30 |
| MOI 1:3 | 1.69 | 4.25 | 2.75 | 8.80 |
| MOI 1:9 | 1.65 | 3.70 | 3.91 | 6.35 |
| MOI Immuno Cult | 0.98 | 2.30 | 0.95 | 3.05 |
| LB 3:1 | 2.10 | 4.25 | 1.45 | 5.00 |
| LB 1:1 | 2.20 | 6.35 | 2.35 | 6.65 |
| LB 1:3 | 2.05 | 9.45 | 2.97 | 10.50 |
| LB 1:9 | 1.55 | 5.60 | 2.77 | 3.75 |
| LB Immuno Cult | 1.05 | 3.10 | 0.86 | 2.30 |

As shown in Table 100, the overall proliferation in both donors was greater at day 7 than at day 4. For donor 1, the proliferation at day 4 among the virally transduced cells was highest when an MOI of 10 was used in conjunction with a bead to cell ratio of 3:1, while donor 2 T cells proliferated the most at a ratio of 1:9. At day 7, 1:1 ratio for donor 1 and 1:3 ratio for donor 2 showed highest cell proliferation. Based on these results a bead to cell ratio of 1:3 was identified as optimal for promoting T cell proliferation.

T cells transduced at various multiplicity of infection (MOI) were also tested using flow cytometry. The results for donor 1 are shown in Table 101.

TABLE 101

| Effect of viral titer and bead to cell ratio | | | | | |
|---|---|---|---|---|---|
| | Bead to cell ratio | | | | |
| MOI | 3:1 | 1:1 | 1:3 | 1:9 | Immunocult |
| 10 MOI | 0.81 | 0.93 | 0.85 | 1.28 | 1.42 |
| 2 MOI | 0.37 | 0.50 | 0.51 | 1.00 | 0.65 |
| 0.4 MOI | 0.33 | 0.46 | 0.50 | 0.72 | 0.86 |

As shown in Table 101, bead ratio of 1:9 showed the highest cell viability among all conditions tested for donor 1. Similar results were obtained for donor 2.

Ratio of CD4 to CD8 within the proliferating T cell populations. At the start of the experiment, the CD4 to CD8 ratio was determined to be 3 and the skewing of populations. The results are shown in Table 102.

TABLE 102

| | CD4 to CD8 cell ratio | | | | | | | | | |
|---|---|---|---|---|---|---|---|---|---|---|
| | Donor 1 | | | | | Donor 2 | | | | |
| MOI | 3:1 | 1:1 | 1:3 | 1:9 | Immunocult | 3:1 | 1:1 | 1:3 | 1:9 | Immunocult |
| 10 | 8.63 | 8.73 | 5.84 | 3.7 | 7.44 | 4.53 | 3.25 | 2.56 | 1.65 | 2.75 |
| 2 | 9.6 | 9.91 | 7.18 | 4.11 | 6.45 | 5.25 | 3.16 | 2.04 | 1.56 | 3.23 |
| 0.4 | 10.85 | 11.33 | 7.51 | 4.23 | 5 | 6.22 | 4.71 | 2.59 | 1.43 | 3.55 |
| LB | 6.95 | 7.24 | 5.24 | 3.21 | 4.96 | 3.86 | 3.27 | 2.18 | 1.23 | 2.78 |

Donor 1 showed CD4 to CD8 ratio close to 3 when a bead to cell ratio of 1:9 was used. Similar results were obtained for donor 2 when a bead to cell ratio of 1:3 was used.

Taken together, these experiments show that activation induced cell death may occur when T cells are overstimulated by beads, and therefore optimal bead to T cell ratio is required. The experiments suggest that the optimal bead to cell ratio was 1:3 across various MOIs.

Example 98. Analysis of BCMA CAR Expression

A BCMA CAR fusion polypeptide was linked to either to the N terminus of the FKBP-DD, ecDHFR-DD or human DHFR-DD and the constructs were cloned into pLVX-IRES-Puro vector under the transcriptional control of EF1a promoter.

Figure 63:
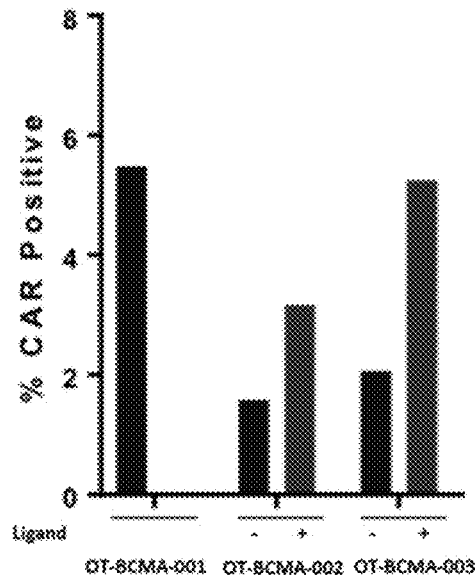
FIG. 63 represents the percentage BCMA CAR positive T cells with ligand treatment.

To test ligand dependent expression of DD-BCMA CAR constructs, 1 million HEK HCT116 cells were cultured in growth medium containing DMEM and 10% FBS and transfected with CAR constructs using Lipofectamine 2000 or LentiBoost. 48 hours after transfection, cells were treated with 1 μM or 10 μM Shield-1, 10 μM Trimethoprim, 1 μM Methotrexate, or vehicle control and incubated for 24 hours. Surface expression of DD-BCMA CAR constructs in HCT116 cells was measured using Fluorescence activated cell sorting (FACS) with Protein L-Biotin-Strepavidin-Allophycocyanin which binds to the kappa light chain of the CAR (ThermoFisher Scientific, Waltham, Mass.). As shown in FIG. 63, surface expression of OT-BCMA-002 with FKBP-DD was elevated in the presence of Shield-1, while OT-BCMA-003 with ecDHFR-DD showed elevated surface expression in the presence of Trimethoprim. As expected, constitutively expressed construct OT-BCMA-001 showed high expression even in the absence of ligand.

Example 99. Analysis of CAR Expression and Function

The expression of chimeric antigen receptors described herein such as, but not limited to CD22 CAR, ALK CAR, CD33 CAR, HER2 CAR and GD2 CAR constructs are fused to destabilizing domains such as ecDHFR DD, FKBP DD and hDHFR DDs. To test ligand dependent expression of the constructs, immune cells are cultured in growth medium containing DMEM and 10% and transduced are transduced with the CAR constructs. 48 hours after transduction, cells are treated with the ligand corresponding to the DD such as 1 μM or 10 μM Shield-1, 10 μM Trimethoprim, 1 μM Methotrexate, or vehicle control and incubated for 24 hours. Cells are then analyzed by western blot using the CD3 Zeta, a component of the CAR. Surface expression of the CAR is analyzed by FACS using Protein L. Intracellular and surface expression of CARs is expected to be undetectable in the absence of ligand, but strongly induced by the presence of the ligand.

The efficacy of T cells expressing DD regulated CAR constructs in functionally interacting with target cells is evaluated. To interact with the CAR T cells, the chosen target cells express the antigen related to the CAR either naturally or ectopically. For example, target cells which have high endogenous expression of BCMA include KMS11, MM-1S, RPMI-8226 cells; target cells expressing CD33 include HL-60, MOLM13, MOLM14 cells. Alternatively, target cell lines may be engineered to ectopically express the antigen in cell lines that have low endogenous expression of the antigen.

Multiple assays are used to measure functionality. Prior to co culture, the target cells are optionally cultured in the presence of mitomycin C to prevent target cell proliferation. This ensures that target cell growth does not out compete T cell growth. Cytotoxicity assays are used to measure the ability of T cells induce target cell death. Target cells are engineered to express Renilla or Firefly luciferase and co cultured with T cells expressing DD regulated CAR constructs for 18 to 24 hours in the presence of the ligand related to the DD or vehicle control. At the end of co culture, cells are lysed and luciferase activity is measured using appropriate substrate. Luciferase activity is expected to increase when DD regulated CAR expressing T cells are co cultured with antigen expressing target cells in the presence of ligand. Cytotoxicity is not expected in vehicle control cells or when the target cells do not express the antigen are utilized.

Cytolytic potential of DD CAR expressing cells is evaluated in primary human T cells or human cell lines (e.g. NALM6, K562 and Raji) using Chromium-51 Release Assay. Target cells are loaded with of $Na_2$ $^{51}CrO_4$, washed twice and resuspended in phenol red-free growth medium. Untreated or ligand treated DD CAR and mock transduced cells are co-incubated with cognate antigen expressing target cells at various effector: target cell ratios, and chromium release into the supernatant is measured using a liquid scintillation counter. Cells with DD CAR are expected to demonstrate specific cytolysis only in the presence of ligand. Cells with DDCAR in the absence of ligand or mock transfected cells are expected to show minimal cytolytic activity.

Activation of T cells results in degranulation, an exocytic process by which cytotoxic T cells release molecules like perforin and granzymes which enable target cell killing.

Degranulation is measured by analysis of media for indications of exocytosis e.g. CD107 by FACS and by markers of degranulation such as perforin and granzyme using immunoassays.

Engagement of the CAR with its cognate antigen results in the activation of T cells is measured 24 hours after co culture of CAR expressing T cells and target cells. Activation of T cells is evaluated by measuring levels of IFNg, IL2, and CD69. T cell proliferation in response to antigen mediated T cell activation is measured by labelling T cells with Carboxyfluorescein succinimidyl ester, which is used to trace cells across multiple generations. Labelled T cells are cultured with Mitomycin treated target cells and cell proliferation is tracked over a period of 3 to 5 days. T cell proliferation and activation is expected to increase when DD regulated CAR expressing T cells are co cultured with cognate antigen expressing target cells in the presence of ligand. Both parameters are not expected in to change in vehicle control cells or when the target cells do not express antigen are utilized.

To measure the ability of DD regulated CARs to promote tumor-free survival, mice are injected intravenously with antigen positive target cells. Following injections, mice are treated with untransduced mock T cells or T cells that are transduced with antigen specific chimeric antigen receptors. Mice are then split into two cohorts; one cohort is treated with the ligand specific to the SRE and the second cohort which is treated with the vehicle control. Survival of the mice is monitored for up to 80 days after the administration of target cells. Tumor bearing mice treated with CAR transduced T cells and the ligand, are expected to survive longer than mice treated with untransduced cells; vector control transduced T cells or vehicle control.

To measure ligand induced reduction in tumor growth, mice are injected orthotopically with antigen positive target cells on day 0. The mice are then treated with cyclophosphamide intraperitoneally on day 3. Cells are treated with antigen specific CAR construct. The mice are treated with recombinant interleukin 7 or interleukin 7 complexed with IL7 antibody, two-three times a week for three weeks to promote T cell persistence. Mice are then split into two cohorts; one cohort is treated with the ligand specific to the SRE and the second cohort which is treated with the vehicle control. The size of the tumors is measured at various time points after inoculation. Mice treated with antigen specific CAR and the ligand are expected to be tumor free while mice treated with mock transduced cells, or vehicle controlled cells are predicted to succumb to the tumors To test if DD regulated CARs can cause regression of established tumors in a ligand dependent fashion, mice are orthotopically inoculated with antigen positive T cells expressing luciferase. Tumors are allowed to grow for 8 days, and the growth is monitored using bioluminescent imaging. On day 8, after tumor inoculation, CAR transduced cells are injected intravenously with or without cytokine and cytotoxic therapy augmentation. Concurrent ligand or vehicle control treatment is also initiated. Mice treated with CAR T cells are expected to show tumor regression and long term disease control in the presence of ligand, whereas all mice treated with mock transduced cells are expected to succumb to progressive tumor growth.

Example 100. Measuring T Cell Exhaustion Phenotype and its Reversal

Primary T cells are activated using soluble CD3/CD28 or CD3/CD28 dynabeads. 24 hours later, cells are transduced with DD regulated CD19 CAR constructs and allowed to rest for 24 hours. Cells are then treated with the ligand specific to the SRE or vehicle control. At day 4, the CD3/CD28 beads are removed and the cells are cultured for another 3 days. At day 7, cells are washed extensively to remove the ligand and replated in the absence of the ligand and cultured for 3 days. At day 10, cells were washed and replated in the absence of ligand. A sample of the cells are analyzed at day 10 for phenotypic and functional markers associated with exhaustion. The rest of the cells are cultured for 3 days in the absence of ligand and analyzed for phenotypic and functional exhaustion markers at day 14. T cells cultured for the duration of the experiment either in the presence or absence of ligand are included as controls. Phenotypic markers for exhaustion such as PD1, TIM3, LAG3, BTLA, CD160, 2B4, and CD39a are measured both in CD4 and CD8 T cell populations. Since chronic T cell activation has been shown to result in T cell exhaustion, T cells cultured under the continuous presence of ligand throughout the experiment are expected to be positive for multiple markers of exhaustion. T cells cultured in the absence of ligand throughout the experiment are expected to negative for multiple markers of exhaustion, since the expression of the CAR will be undetectable/low in the absence of ligand. At day 10, cells where the ligand is removed at day 7 are expected to have a lower percentage of cells that are positive for multiple exhaustion markers when compared to cells that have been treated with ligand throughout the duration of the experiment. This result is expected in both CD8 and CD4 population of T cells.

Example 101. Dual Specific Chimeric Antigen Receptor

Human T cells are transduced with a lentiviral vector encoding dual specific chimeric antigen receptors. Dual specific CARs targets include, but not limited to GD2, CD33, BCMA, Her2, ALK, CD22 and CD276. Cells are cultured in the presence of ligand or vehicle control for 24-48 hours. Additional controls such as human T cells that are mock transduced or transduced with a vector encoding septicity to one antigen only are included. CAR expression is evaluated by flow cytometry using anti-idiotype CAR antibody. Expression of dual specific CAR is expected only in cells transduced with dual specific CAR construct in the presence of ligand, while the controls transduced with the CAR constructs showing single specificity are expected to show expression of the single CAR construct, and in the presence of ligand.

T cells are also analyzed for proliferation, markers of apoptosis and memory phenotype. Cells are cultured per methods described above. Ligand is removed either at day 7 or day 10 and cells are analyzed at day 14 for apoptosis using Annexin V staining and for the memory phenotype using CD62L as the marker. When compared to untreated cells, cells continuously treated with ligand are expected to show an increase in apoptotic cells, a decrease in proliferation and a decrease in CD62L expression, which are indicative of T cell exhaustion. Ligand withdrawal at day 7 or day 10 is expected to show low Annexin V and high CD62L expression, and an increase in proliferation similar to untreated cells.

Example 102. Measuring T Cell Exhaustion Phenotype and its Reversal

Primary T cells are activated using soluble CD3/CD28 or CD3/CD28 dynabeads. 24 hours later, cells are transduced with DD regulated CD19 CAR constructs and allowed to rest for 24 hours. Cells are then treated with the ligand specific to the SRE or vehicle control. At day 4, the CD3/CD28 beads are removed and the cells are cultured for another 3 days. At day 7, cells are washed extensively to remove the ligand and replated in the absence of the ligand and cultured for 3 days. At day 10, cells were washed and replated in the absence of ligand. A sample of the cells are analyzed at day 10 for phenotypic and functional markers associated with exhaustion. The rest of the cells are cultured for 3 days in the absence of ligand and analyzed for phenotypic and functional exhaustion markers at day 14. T cells cultured for the duration of the experiment either in the presence or absence of ligand are included as controls. Phenotypic markers for exhaustion such as PD1, TIM3, LAG3, BTLA, CD160, 2B4, and CD39a are measured both in CD4 and CD8 T cell populations. Since chronic T cell activation has been shown to result in T cell exhaustion, T cells cultured under the continuous presence of ligand throughout the experiment are expected to be positive for multiple markers of exhaustion. T cells cultured in the absence of ligand throughout the experiment are expected to be negative for multiple markers of exhaustion, since the expression of the CAR will be undetectable/low in the absence of ligand. At day 10, cells where the ligand is removed at day 7 are expected to have a lower percentage of cells that are positive for multiple exhaustion markers when compared to cells that have been treated with ligand throughout the duration of the experiment. This result is expected in both CD8 and CD4 population of T cells.

T cells are also analyzed for proliferation, markers of apoptosis and memory phenotype. Cells are cultured per methods described above. Ligand is removed either at day 7 or day 10 and cells are analyzed at day 14 for apoptosis using Annexin V staining and for the memory phenotype using CD62L as the marker. When compared to untreated cells, cells continuously treated with ligand are expected to show an increase in apoptotic cells, a decrease in proliferation and a decrease in CD62L expression, which are indicative of T cell exhaustion. Ligand withdrawal at day 7 or day 10 is expected to show low Annexin V and high CD62L expression, and an increase in proliferation similar to untreated cells.

Example 103. Functional Analysis of Reversal of T Cell Exhaustion

The functionality of T cells expressing DD regulated CAR constructs is evaluated by measuring cytokine release. T cells expressing DD CAR constructs are co cultured with target cells expressing the antigen (endogenously or ectopically). T cells are activated at day 0 using CD3/CD28 beads. 24 hours later, cells are transduced with DD regulated CAR constructs and allowed to rest for 24 hours. Cells are then treated with the ligand specific to the SRE or vehicle control. At day 4, the CD3/CD28 beads are removed and the cells are cultured for another 3 days. At day 7, cells are washed extensively to remove the ligand and replated in the absence of the ligand and cultured for 3 days. In an additional experimental condition, cells are treated with ligand till day 10 instead of day 7. T cells cultured for the duration of the experiment either in the presence or absence of ligand are included as controls. Supernatant was collected from cells after 24 hours and IL2 and IFNg levels were measured as a read out of T cell function. When compared to untreated cells, cells continuously treated with ligand are expected to show an increase in IL2 and IFNg expression at day 14, which are indicative of functional T cells. Ligand withdrawal at day 7 or day 10 is expected to minimally affect the levels of IFNg and IL2 levels.

The ability of biocircuits of the invention to functionally rescue the exhausted T cells is also evaluated. T cells treated with ligand till day 10 are sorted and selected for cells that are positive for chimeric antigen receptor as well as multiple exhaustion makers (e.g. PD1, TIM3, LAG3). The cells are divided into two groups, one group is treated with ligand, while the second group is treated with vehicle control. Functionality of T cells is measured using IL2 levels as a surrogate. Ligand withdrawal is predicted to reverse T cell exhaustion, and hence cells subject to ligand withdrawal at day 10 are expected to have higher IL2 levels compared to ligand treated cells.

Embodiments

1. In embodiment one, a biocircuit system comprising at least one effector module, said effector module comprising
(a) a stimulus response element (SRE) and
(b) at least one payload, said payload comprising a protein of interest which is attached, appended or associated with said SRE,
wherein said SRE comprises a destabilizing domain (DD), said DD comprising, in whole or in part, a protein selected from the group consisting of human dihydrofolate reductase (hDHFR; SEQ ID NO. 1), a hDHFR mutant and a hDHFR variant.

2. In the biocircuit system of embodiment 1, wherein the DD comprises, in whole or in part, a hDHFR mutant.

3. In embodiment 1 or 2, wherein the effector module is responsive to one or more stimuli.

4. The biocircuit system of embodiment 2, wherein the hDHFR mutant comprises one, two, three or more mutations relative to SEQ ID NO. 1, said mutation selected from the group consisting of M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I511V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

5. The biocircuit system of any of embodiments 1-4, wherein the hDHFR mutant comprises one, or more mutations which are made to result in an amino acid at the mutation site being identical to one or more vicinal amino acids, wherein the vicinal amino acid is selected from one, two, three, four, and five amino acids, upstream or downstream from the mutation.

6. The biocircuit system of embodiment 4, wherein the hDHFR mutant is selected from the group consisting of hDHFR (A107V), comprising the amino acid sequence of SEQ ID NO. 6415; hDHFR (F59S), comprising the amino acid sequence of SEQ ID NO. 6416; hDHFR (I117V), comprising the amino acid sequence of SEQ ID NO. 6417; hDHFR (K185E), comprising the amino acid sequence of SEQ ID NO. 6418; hDHFR (K81R), comprising the amino acid sequence of SEQ ID NO. 6419; hDHFR (M140I), comprising the amino acid sequence of SEQ ID NO. 6420; hDHFR (N127Y), comprising the amino acid sequence of SEQ ID NO. 6421; hDHFR (N186D), comprising the amino acid sequence of SEQ ID NO. 6422; hDHFR (N65D), comprising the amino acid sequence of SEQ ID NO. 6423; hDHFR (Y122I), comprising the amino acid sequence of SEQ ID NO. 6424; hDHFR (A10V, H88Y), comprising the amino acid sequence of SEQ ID NO. 6425; hDHFR (Amino acid 2-187 of WT) (Y122I), comprising the amino acid sequence of SEQ ID NO. 6426; hDHFR (C7R, Y163C), comprising the amino acid sequence of SEQ ID NO. 6427; hDHFR (E162G, I176F), comprising the amino acid sequence of SEQ ID NO. 6428; hDHFR (G21T, Y122I), comprising the amino acid sequence of SEQ ID NO. 6429; hDHFR (H131R, E144G), comprising the amino acid sequence of SEQ ID NO. 6430; hDHFR (I17V, Y122I), comprising the amino acid sequence of SEQ ID NO. 6431; hDHFR (L74N, Y122I), comprising the amino acid sequence of SEQ ID NO. 6432; hDHFR (L94A, T147A), comprising the amino acid sequence of SEQ ID NO. 6433; hDHFR (M53T, R138I), comprising the amino acid sequence of SEQ ID NO. 6434; hDHFR (N127Y, Y122I), comprising the amino acid sequence of SEQ ID NO. 6435; hDHFR (Q36K, Y122I), comprising the amino acid sequence of SEQ ID NO. 6436; hDHFR (T137R, F143L), comprising the amino acid sequence of SEQ ID NO. 6437; hDHFR (T57A, I72A), comprising the amino acid sequence of SEQ ID NO. 6438; hDHFR (V121A, Y122I), comprising the amino acid sequence of SEQ ID NO. 6439; hDHFR (V75F, Y122I), comprising the amino acid sequence of SEQ ID NO. 6440; hDHFR (Y122I, A125F), comprising the amino acid sequence of SEQ ID NO. 6441; hDHFR (Y122I, M140I), comprising the amino acid sequence of SEQ ID NO. 6442; hDHFR (Y178H, E181G), comprising the amino acid sequence of SEQ ID NO. 6443; hDHFR (Y183H, K185E), comprising the amino acid sequence of SEQ ID NO. 6444; hDHFR (Amino acid 2-187 of WT) (G21T, Y122I), comprising the amino acid sequence of SEQ ID NO. 6445; hDHFR (Amino acid 2-187 of WT) (I17V, Y122I), comprising the amino acid sequence of SEQ ID NO. 6446; hDHFR (Amino acid 2-187 of WT) (L74N, Y122I), comprising the amino acid sequence of SEQ ID NO. 6447; hDHFR (Amino acid 2-187 of WT) (L94A, T147A), comprising the amino acid sequence of SEQ ID NO. 6448; hDHFR (Amino acid 2-187 of WT) (M53T, R138I), comprising the amino acid sequence of SEQ ID NO. 6449; hDHFR (Amino acid 2-187 of WT) (N127Y, Y122I), comprising the amino acid sequence of SEQ ID NO. 6450; hDHFR (Amino acid 2-187 of WT) (Q36K, Y122I), comprising the amino acid sequence of SEQ ID NO. 6451; hDHFR (Amino acid 2-187 of WT) (V121A, Y122I), comprising the amino acid sequence of SEQ ID NO. 6452; hDHFR (Amino acid 2-187 of WT) (V75F, Y122I), comprising the amino acid sequence of SEQ ID NO. 6453; hDHFR (Amino acid 2-187 of WT) (Y122I, A125F), comprising the amino acid sequence of SEQ ID NO. 6454; hDHFR (Amino acid 2-187 of WT) (Y122I, M140I), comprising the amino acid sequence of SEQ ID NO. 6455; hDHFR (E31D, F32M, V116I), comprising the amino acid sequence of SEQ ID NO. 6456; hDHFR (G21E, I72V, I176T), comprising the amino acid sequence of SEQ ID NO. 6457; hDHFR (I8V, K133E, Y163C), comprising the amino acid sequence of SEQ ID NO. 6458; hDHFR (K19E, F89L, E181G), comprising the amino acid sequence of SEQ ID NO. 6459; hDHFR (L23S, V121A, Y157C), comprising the amino acid sequence of SEQ ID NO. 6460; hDHFR (N49D, F59S, D153G), comprising the amino acid sequence of SEQ ID NO. 6461; hDHFR (Q36F, N65F, Y122I), comprising the amino acid sequence of SEQ ID NO. 6462; hDHFR (Q36F, Y122I, A125F), comprising the amino acid sequence of SEQ ID NO. 6463; hDHFR (V110A, V136M, K177R), comprising the amino acid sequence of SEQ ID NO. 6464; hDHFR (V9A, S93R, P150L), comprising the amino acid sequence of SEQ ID NO. 6465; hDHFR (Y122I, H131R, E144G), comprising the amino acid sequence of SEQ ID NO. 6466; hDHFR (G54R, I115L, M140V, S168C), comprising the amino acid sequence of SEQ ID NO. 6467; hDHFR (Amino acid 2-187 of WT) (E31D, F32M, V116I), comprising the amino acid sequence of SEQ ID NO. 6468; hDHFR (Amino acid 2-187 of WT) (Q36F, N65F, Y122I), comprising the amino acid sequence of SEQ ID NO. 6469; hDHFR (Amino acid 2-187 of WT) (Q36F, Y122I, A125F), comprising the amino acid sequence of SEQ ID NO. 6470; hDHFR (Amino acid 2-187 of WT) (Y122I, H131R, E144G), comprising the amino acid sequence of SEQ ID NO. 6471; hDHFR (V2A, R33G, Q36R, L100P, K185R), comprising the amino acid sequence of SEQ ID NO. 6472; hDHFR(D22S, F32M, R33S, Q36S, N65S), comprising the amino acid sequence of SEQ ID NO. 6473; hDHFR (Amino acid 2-187 of WT) (D22S, F32M, R33S, Q36S, N65S), comprising the amino acid sequence of SEQ ID NO. 6474; hDHFR (I17N, L98S, K99R, M112T, E151G, E162G, E172G), comprising the amino acid sequence of SEQ ID NO. 6475; hDHFR (G16S, I17V, F89L, D96G, K123E, M140V, D146G, K156R), comprising the amino acid sequence of SEQ ID NO. 6476; hDHFR (K81R, K99R, L100P, E102G, N108D, K123R, H128R, D142G, F180L, K185E), comprising the amino acid sequence of SEQ ID NO. 6477; hDHFR (R138G, D142G, F143S, K156R, K158E, E162G, V166A, K177E, Y178C, K185E, N186S), comprising the amino acid sequence of SEQ ID NO. 6478; hDHFR (N14S, P24S, F35L, M53T, K56E, R92G, S93G, N127S, H128Y, F135L, F143S, L159P, L160P, E173A, F180L), comprising the amino acid sequence of SEQ ID NO. 6479; hDHFR (F35L, R37G, N65A, L68S, K69E, R71G, L80P, K99G, G117D, L132P, I139V, M140I, D142G, D146G, E173G, D187G), comprising the amino acid sequence of SEQ ID NO. 6480; hDHFR (L28P, N30H, M38V, V44A, L68S, N73G, R78G, A97T, K99R, A107T, K109R, D111N, L134P, F135V, T147A, I152V, K158R, E172G, V182A, E184R), comprising the amino acid sequence of SEQ ID NO. 6481; hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), comprising the amino acid sequence of SEQ ID NO. 6482; hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), comprising the amino acid sequence of SEQ ID NO. 6483; and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N), comprising the amino acid sequence of SEQ ID NO. 6484.

7. The biocircuit system of embodiment 6, wherein the hDHFR mutant is encoded by a nucleic acid sequence independently selected from any of SEQ ID NOs. 6485-6499, 6500-6553, or 6554.

8. The biocircuit system of embodiment 3, wherein said one or more stimuli is Trimethoprim (TMP) or Methotrexate (MTX).

9 The biocircuit system of any of embodiments 3-6 or 8, wherein the hDHFR mutant comprises one or more mutations in a region that does interact directly with the stimulus.

10. An effector module comprising a hDHFR-derived SRE operably linked to a payload, wherein the hDHFR-derived SRE is a hDHFR mutant comprising one, two, three or more mutations selected from M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

11. The effector module of embodiment 10, wherein the DHFR-derived SRE is selected from hDHFR (A107V), comprising the amino acid sequence of SEQ ID NO. 6555; hDHFR (F59S), comprising the amino acid sequence of SEQ ID NO. 6556; hDHFR (I17V), comprising the amino acid sequence of SEQ ID NO. 6557; hDHFR (K185E), comprising the amino acid sequence of SEQ ID NO. 6558; hDHFR (K81R), comprising the amino acid sequence of SEQ ID NO. 6559; hDHFR (M140I), comprising the amino acid sequence of SEQ ID NO. 6560; hDHFR (N127Y), comprising the amino acid sequence of SEQ ID NO. 6561; hDHFR (N186D), comprising the amino acid sequence of SEQ ID NO. 6562; hDHFR (N65D), comprising the amino acid sequence of SEQ ID NO. 6563; hDHFR (Y122I), comprising the amino acid sequence of SEQ ID NO. 6564; hDHFR (A10V, H88Y), comprising the amino acid sequence of SEQ ID NO. 6565; hDHFR (Amino acid 2-187 of WT) (Y122I), comprising the amino acid sequence of SEQ ID NO. 6566; hDHFR (C7R, Y163C), comprising the amino acid sequence of SEQ ID NO. 6567; hDHFR (E162G, I176F), comprising the amino acid sequence of SEQ ID NO. 6568; hDHFR (G21T, Y122I), comprising the amino acid sequence of SEQ ID NO. 6569; hDHFR (H131R, E144G), comprising the amino acid sequence of SEQ ID NO. 6570; hDHFR (I17V, Y122I), comprising the amino acid sequence of SEQ ID NO. 6571; hDHFR (L74N, Y122I), comprising the amino acid sequence of SEQ ID NO. 6572; hDHFR (L94A, T147A), comprising the amino acid sequence of SEQ ID NO. 6573; hDHFR (M53T, R138I), comprising the amino acid sequence of SEQ ID NO. 6574; hDHFR (N127Y, Y122I), comprising the amino acid sequence of SEQ ID NO. 6575; hDHFR (Q36K, Y122I), comprising the amino acid sequence of SEQ ID NO. 6576; hDHFR (T137R, F143L), comprising the amino acid sequence of SEQ ID NO. 6577; hDHFR (T57A, I72A), comprising the amino acid sequence of SEQ ID NO. 6578; hDHFR (V121A, Y122I), comprising the amino acid sequence of SEQ ID NO. 6579; hDHFR (V75F, Y122I), comprising the amino acid sequence of SEQ ID NO. 6580; hDHFR (Y122I, A125F), comprising the amino acid sequence of SEQ ID NO. 6581; hDHFR (Y122I, M140I), comprising the amino acid sequence of SEQ ID NO. 6582; hDHFR (Y178H, E181G), comprising the amino acid sequence of SEQ ID NO. 6583; hDHFR (Y183H, K185E), comprising the amino acid sequence of SEQ ID NO. 6584; hDHFR (Amino acid 2-187 of WT) (G21T, Y122I), comprising the amino acid sequence of SEQ ID NO. 6585; hDHFR (Amino acid 2-187 of WT) (I17V, Y122I), comprising the amino acid sequence of SEQ ID NO. 6586; hDHFR (Amino acid 2-187 of WT) (L74N, Y122I), comprising the amino acid sequence of SEQ ID NO. 6587; hDHFR (Amino acid 2-187 of WT) (L94A, T147A), comprising the amino acid sequence of SEQ ID NO. 6588; hDHFR (Amino acid 2-187 of WT) (M53T, R138I), comprising the amino acid sequence of SEQ ID NO. 6589; hDHFR (Amino acid 2-187 of WT) (N127Y, Y122I), comprising the amino acid sequence of SEQ ID NO. 6590; hDHFR (Amino acid 2-187 of WT) (Q36K, Y122I), comprising the amino acid sequence of SEQ ID NO. 6591; hDHFR (Amino acid 2-187 of WT) (V121A, Y122I), comprising the amino acid sequence of SEQ ID NO. 6592; hDHFR (Amino acid 2-187 of WT) (V75F, Y122I), comprising the amino acid sequence of SEQ ID NO. 6593; hDHFR (Amino acid 2-187 of WT) (Y122I, A125F), comprising the amino acid sequence of SEQ ID NO. 6594; hDHFR (Amino acid 2-187 of WT) (Y122I, M140I), comprising the amino acid sequence of SEQ ID NO. 6595; hDHFR (E31D, F32M, V116I), comprising the amino acid sequence of SEQ ID NO. 6596; hDHFR (G21E, I72V, I176T), comprising the amino acid sequence of SEQ ID NO. 6597; hDHFR (I8V, K133E, Y163C), comprising the amino acid sequence of SEQ ID NO. 6598; hDHFR (K19E, F89L, E181G), comprising the amino acid sequence of SEQ ID NO. 6599; hDHFR (L23S, V121A, Y157C), comprising the amino acid sequence of SEQ ID NO. 6600; hDHFR (N49D, F59S, D153G), comprising the amino acid sequence of SEQ ID NO. 6601; hDHFR (Q36F, N65F, Y122I), comprising the amino acid sequence of SEQ ID NO. 6602; hDHFR (Q36F, Y122I, A125F), comprising the amino acid sequence of SEQ ID NO. 6603; hDHFR (V110A, V136M, K177R), comprising the amino acid sequence of SEQ ID NO. 6604; hDHFR (V9A, S93R, P150L), comprising the amino acid sequence of SEQ ID NO. 6605; hDHFR (Y122I, H131R, E144G), comprising the amino acid sequence of SEQ ID NO. 6606; hDHFR (G54R, I115L, M140V, S168C), comprising the amino acid sequence of SEQ ID NO. 6607; hDHFR (Amino acid 2-187 of WT) (E31D, F32M, V116I), comprising the amino acid sequence of SEQ ID NO. 6608; hDHFR (Amino acid 2-187 of WT) (Q36F, N65F, Y122I), comprising the amino acid sequence of SEQ ID NO. 6609; hDHFR (Amino acid 2-187 of WT) (Q36F, Y122I, A125F), comprising the amino acid sequence of SEQ ID NO. 6610; hDHFR (Amino acid 2-187 of WT) (Y122I, H131R, E144G), comprising the amino acid sequence of SEQ ID NO. 6611; hDHFR (V2A, R33G, Q36R, L100P, K185R), comprising the amino acid sequence of SEQ ID NO. 6612; hDHFR(D22S, F32M, R33S, Q36S, N65 S), comprising the amino acid sequence of SEQ ID NO. 6613; hDHFR (Amino acid 2-187 of WT) (D22S, F32M, R33S, Q36S, N65S), comprising the amino acid sequence of SEQ ID NO. 6614; hDHFR (I17N, L98S, K99R, M112T, E151G, E162G, E172G), comprising the amino acid sequence of SEQ ID NO. 6615; hDHFR (G16S, I17V, F89L, D96G, K123E, M140V, D146G, K156R), comprising the amino acid sequence of SEQ ID NO. 6616; hDHFR (K81R, K99R, L100P, E102G, N108D, K123R, H128R, D142G, F180L, K185E), comprising the amino acid sequence of SEQ ID NO. 6617; hDHFR (R138G, D142G, F143S, K156R, K158E, E162G, V166A, K177E, Y178C, K185E, N186S), comprising the amino acid sequence of SEQ ID NO. 6618; hDHFR (N14S, P24S, F35L, M53T, K56E, R92G, S93G, N127S, H128Y, F135L, F143S, L159P, L160P, E173A, F180L), comprising the amino acid sequence of SEQ ID NO. 6619; hDHFR (F35L, R37G, N65A, L68S, K69E, R71G, L80P, K99G, G117D, L132P, I139V, M140I, D142G, D146G, E173G, D187G), comprising the amino acid sequence of SEQ ID NO. 6620; hDHFR (L28P, N30H, M38V, V44A, L68S, N73G, R78G, A97T, K99R, A107T, K109R, D111N, L134P, F135V, T147A, I152V, K158R, E172G, V182A, E184R), comprising the amino acid sequence of SEQ ID NO. 6621; hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), comprising the amino acid sequence of SEQ ID NO. 6622; hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), comprising the amino acid sequence of SEQ ID NO. 6623; and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N), comprising the amino acid sequence of SEQ ID NO. 6624.

12. The effector module of embodiment 10 or 11, wherein the payload is a natural protein or a variant thereof, or a fusion polypeptide, or an antibody or a fragment thereof, or a therapeutic agent, or a gene therapy agent.

13. The effector module of embodiment 12 further comprising a signal peptide, a regulatory sequence, a linker, a label, and/or a protein cleavage site.

14. The effector module of embodiment 13, wherein the effector module comprises a protein cleavage site and said protein cleavage site is a furin cleavage site, or a modified a furin cleavage site.

15. The effector module of embodiment 10 or 11, wherein the hDHFR-derived SRE of the effector module exhibits both: (a) a destabilization ratio between 0, and 0.09, wherein the destabilization ratio comprises the ratio of expression, function or level of the payload in the absence of the stimulus specific to the hDHFR-derived SRE to the expression, function or level of the payload that is expressed constitutively in the absence of the same stimulus, and (b) a destabilizing mutation co-efficient between 0 and 0.09, wherein the destabilizing mutation co-efficient comprises the ratio of expression, function or level of the payload when operably linked to the hDHFR-derived SRE, in the absence of the stimulus specific to the hDHFR-derived SRE; to the expression, function or level of the payload when operably linked to the wildtype protein from which the hDHFR-derived SRE is derived and in the absence of the same stimulus.

16. The effector module of embodiment 15, wherein the hDHFR-derived SRE stabilizes the payload by a stabilization ratio of 1 or more, wherein the stabilization ratio comprises the ratio of expression, function or level of the payload in the presence of the stimulus to the expression, function or level of the payload in the absence of the stimulus.

17. The effector module of embodiment 15 or 16, wherein the payload is a protein of interest.

18. A vector comprising a nucleic acid sequence independently selected from any of SEQ ID NOs. 6625-6668, or 419-422, 4358 and 2739.

19. The vector of embodiment 18, wherein the vector is a viral vector selected from a retroviral vector, a lentiviral vector, a rAAV vector, and an oncolytic viral vector.

20. A method of tuning the expression level and/or activity of a protein of interest comprising appending or attaching to said protein of interest a hDHFR mutant comprising one, two, three or more mutations selected from M1del, V2A, C7R, 18V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, I115L, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

In a further aspect, the biocircuits, stimulus response elements, compositions and methods are discussed further in the following embodiments.

1. A composition for inducing an immune response in a cell or a subject comprising a first effector module, said effector module comprising a first stimulus response element (SRE) operably linked to at least one immunotherapeutic agent.

2. The composition of embodiment 1, wherein said at least one immunotherapeutic agent is selected from a chimeric antigen receptor (CAR) and an antibody.

3. The composition of embodiment 2, wherein said first SRE is responsive to or interacts with at least one stimulus.

4. The composition of embodiment 3, wherein said first SRE is a destabilizing domain (DD).

5. The composition of embodiment 4, wherein the DD is derived from a parent protein or a mutant protein having one, two, three or more amino acid mutations compared to said parent protein, wherein the parent protein is selected from: (a) human protein FKBP comprising the amino acid sequence of SEQ ID NO. 6774, (b) human DHFR (hDHFR) comprising the amino acid sequence of SEQ ID NO. 6775, (c) *E. coli* DHFR (ecDHFR) comprising the amino acid sequence of SEQ ID NO. 6776, (d) PDE5 comprising the amino acid sequence of SEQ ID NO. 6777, (e) PPAR gamma comprising the amino acid sequence of SEQ ID NO. 6778, (f) CA2 comprising the amino acid sequence of SEQ ID NO. 6779, and (g) NQO2 comprising the amino acid sequence of SEQ ID NO. 6780.

6. The composition of embodiment 5, wherein the parent protein is hDHFR and the DD comprises a mutant protein having: (a) a single mutation selected from hDHFR (I17V), hDHFR (F59S), hDHFR (N65D), hDHFR (K81R), hDHFR (A107V), hDHFR (Y122I), hDHFR (N127Y), hDHFR (M140I), hDHFR (K185E), hDHFR (N186D), hDHFR (M140I), hDHFR (Amino acid 2-187 of WT; N127Y), hDHFR (Amino acid 2-187 of WT; I17V), hDHFR (Amino acid 2-187 of WT; Y122I), and hDHFR (Amino acid 2-187 of WT; K185E); (b) a double mutation selected from hDHFR (C7R, Y163C), hDHFR (A10V, H88Y), hDHFR (Q36K, Y122I), hDHFR (M53T, R138I), hDHFR (T57A, I72A), hDHFR (E63G, I176F), hDHFR (G21T, Y122I), hDHFR (L74N, Y122I), hDHFR (V75F, Y122I), hDHFR (L94A, T147A), hDHFR (V121A, Y22I), hDHFR (Y122I, A125F), hDHFR (H131R, E144G), hDHFR (T137R, F143L), hDHFR (Y178H, E181G), hDHFR (Y183H, K185E), hDHFR (E162G, I176F) hDHFR (Amino acid 2-187 of WT; I17V, Y122I), hDHFR (Amino acid 2-187 of WT; Y122I, M140I), hDHFR (Amino acid 2-187 of WT; N127Y, Y122I), hDHFR (Amino acid 2-187 of WT; E162G, I176F), and hDHFR (Amino acid 2-187 of WT; H131R, E144G), and hDHFR (Amino acid 2-187 of WT; Y122I, A125F); (c) a triple mutation selected from hDHFR (V9A, S93R, P150L), hDHFR (18V, K133E, Y163C), hDHFR (L23S, V121A, Y157C), hDHFR (K19E, F89L, E181G), hDHFR (Q36F, N65F, Y122I), hDHFR (G54R, M140V, S168C), hDHFR (V110A, V136M, K177R), hDHFR (Q36F, Y122I, A125F), hDHFR (N49D, F59S, D153G), hDHFR (G21E, I72V, I176T), hDHFR (Amino acid 2-187 of WT; Q36F, Y122I, A125F), hDHFR (Amino acid 2-187 of WT; Y122I, H131R, E144G), hDHFR (Amino acid 2-187 of WT; E31D, F32M, V116I), and hDHFR (Amino acid 2-187 of WT; Q36F, N65F, Y122I); or (d) a quadruple or higher mutation selected from hDHFR (V2A, R33G, Q36R, L100P, K185R), hDHFR (Amino acid 2-187 of WT; D22S, F32M, R33S, Q36S, N65S), hDHFR (I17N, L98S, K99R, M112T, E151G, E162G, E172G), hDHFR (G16S, I17V, F89L, D96G, K123E, M140V, D146G, K156R), hDHFR (K81R, K99R, L100P, E102G, N108D, K123R, H128R, D142G, F180L, K185E), hDHFR (R138G, D142G, F143S, K156R, K158E, E162G, V166A, K177E, Y178C, K185E, N186S), hDHFR (N14S, P24S, F35L, M53T, K56E, R92G, S93G, N127S, H128Y, F135L, F143S, L159P, L160P, E173A, F180L), hDHFR (F35L, R37G, N65A, L68S, K69E, R71G, L80P, K99G, G117D, L132P, I139V, M140I, D142G, D146G, E173G, D187G), hDHFR (L28P, N30H, M38V, V44A, L68S, N73G, R78G, A97T, K99R, A107T, K109R, D111N, L134P, F135V, T147A, I152V, K158R, E172G, V182A, E184R), hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N).

7. The composition of embodiment 6, wherein the stimulus is selected from the group consisting of Trimethoprim (TMP) and Methotrexate (MTX).

8. The composition of embodiment 2, wherein the immunotherapeutic agent is a chimeric antigen receptor (CAR).

9. The composition of embodiment 8, wherein the chimeric antigen receptor (CAR) comprises (a) an extracellular target moiety; (b) a transmembrane domain; (c) an intracellular signaling domain; and (d) optionally, one or more co-stimulatory domains.

10. The composition of embodiment 9, wherein the CAR is a standard CAR, a split CAR, an off-switch CAR, an on-switch CAR, a first-generation CAR, a second-generation CAR, a third-generation CAR, or a fourth-generation CAR.

11. The composition of embodiment 9, wherein the extracellular target moiety recognizes a target molecule on the surface of a cancer cell, wherein said target molecule on the surface of the cancer cell is selected from a cancer antigen, a plasma membrane lipid, a receptor and a membrane bound glycoprotein.

12. The composition of any of embodiments 9-11, wherein the extracellular target moiety is selected from any of:
i. an Ig NAR,
ii. a Fab fragment,
iii. a Fab' fragment,
iv. a F(ab)'2 fragment,
v. a F(ab)'3 fragment,
vi. an Fv,
vii. a single chain variable fragment (scFv),
viii. a bis-scFv, a (scFv)2,
ix. a minibody,
x. a diabody,
xi. a triabody,
xii. a tetrabody,
xiii. an intrabody,
xiv. a disulfide stabilized Fv protein (dsFv),
xv. a unibody,
xvi. a nanobody, and
xvii. an antigen binding region derived from an antibody that specifically binds to any of a protein of interest, a ligand, a receptor, a receptor fragment or a peptide aptamer.

13. The composition of embodiment 12, wherein the extracellular target moiety is a scFv derived from an antibody that specifically binds a CD19 antigen.

14. The composition of embodiment 13, wherein the scFv is a CD19 scFv is selected from one that comprises: (a) a heavy chain variable region having an amino acid sequence independently selected from the group consisting of SEQ ID NO: 6681-6712, and a light chain variable region having an amino acid sequence independently selected from the group consisting of any of SEQ ID NOs: 81-117, 119-122 and 2738; or (b) an amino acid sequence selected from the group consisting of any of SEQ ID NOs: 6752-6896 and 6897.

15. The composition of embodiment 9, wherein (a) the intracellular signaling domain of the CAR is the signaling domain derived from T cell receptor CD3zeta or a cell surface molecule selected from the group consisting of FcR gamma, FcR beta, CD3 gamma, CD3 delta, CD3 epsilon, CD5, CD22, CD79a, CD79b, and CD66d; and (b) the co-stimulatory domain is present and is selected from the group consisting of 2B4, HVEM, ICOS, LAG3, DAP 10, DAP12, CD27, CD28, 4-1BB (CD137), OX40 (CD134), CD30, CD40, ICOS (CD278), glucocorticoid-induced tumor necrosis factor receptor (GITR), lymphocyte function-associated antigen-1 (LFA-1), CD2, CD7, LIGHT, NKG2C, and B7-H3.

16. The composition of embodiment 15, wherein the intracellular signaling domain of the CAR is a T cell receptor CD3zeta signaling domain comprising the amino acid sequence of SEQ ID NO: 6898.

17. The composition of embodiment 9, wherein the intracellular signaling domain of the CAR is a T cell receptor CD3zeta signaling domain comprising the amino acid sequence of SEQ ID NO: 6899 and the co-stimulatory domain is present, said co-stimulatory domain being selected from amino acid sequence of any of SEQ ID NOs: 6900-7006.

18. The composition of embodiment 9, wherein the transmembrane domain is derived from any of the members of the group consisting of: (a) a transmembrane region of an alpha, beta or zeta chain of a T-cell receptor; (b) the CD3 epsilon chain of a T-cell receptor; (c) a molecule selected from CD4, CD5, CD8, CD8a, CD9, CD16, CD22, CD33, CD28, CD37, CD45, CD64, CD80, CD86, CD148, DAP 10, EpoRI, GITR, LAG3, ICOS, Her2, OX40 (CD134), 4-1BB (CD137), CD152, CD154, PD-1, or CTLA-4; and (d) an immunoglobulin selected from IgG1, IgD, IgG4, and an IgG$_4$ Fc region.

19. The composition of embodiment 9, wherein the transmembrane domain comprises an amino acid sequence selected from the group consisting of any of SEQ ID NOs: 375-422, 424-425, 2739 and 7055-7065.

20. The composition of embodiment 9, wherein the CAR further comprises a hinge region near the transmembrane domain, said hinge region comprising an amino acid sequence selected from the group consisting of any of SEQ ID NOs: 7066-7144.

21. The composition of embodiment 2, wherein the immunotherapeutic agent is an antibody that is specifically immunoreactive to an antigen selected from a tumor specific antigen (TSA), a tumor associated antigen (TAA), or an antigenic epitope.

22. The composition of embodiment 21, wherein the antigen is an antigenic epitope and said antigenic epitope is CD19.

23. The composition of embodiment 22, wherein the antibody is selected from one that comprises: (a) a heavy chain variable region having an amino acid sequence independently selected from the group consisting of any of SEQ ID NOs: 7365-4396 and a light chain variable region having an amino acid sequence independently selected from the group consisting of any of SEQ ID NOs: 81-117, 119-122 and 2738; or (b) an amino acid sequence selected from the group consisting of any of SEQ ID NOs: 6752-6896.

24. The composition of embodiment 1 wherein said first effector module comprises the amino acid sequence of any of SEQ ID NO: 7145-7169 and 1214-1230.

25. The composition of embodiment 24, wherein said first SRE of the effector module stabilizes the immunotherapeutic agent by a stabilization ratio of 1 or more, wherein the stabilization ratio comprises the ratio of expression, function or level of the immunotherapeutic agent in the presence of the stimulus to the expression, function or level of the immunotherapeutic agent in the absence of the stimulus.

26. The composition of any of embodiments 24-25, wherein the SRE destabilizes the immunotherapeutic agent by a destabilization ratio between 0, and 0.09, wherein the destabilization ratio comprises the ratio of expression, function or level of the immunotherapeutic agent in the absence of the stimulus specific to the SRE to the expression, function or level of the immunotherapeutic agent that is expressed constitutively, and in the absence of the stimulus specific to the SRE.

27. A polynucleotide encoding any of the compositions of embodiments 1-26.

28. The polynucleotide of embodiment 27, wherein the polynucleotide is a DNA molecule, or a RNA molecule.

29. The polynucleotide of embodiment 28, wherein the polynucleotide is an RNA molecule and said RNA molecule is a messenger RNA.

30. The polynucleotide of embodiment 29, which is chemically modified.

31. The polynucleotide of embodiment 28, which comprises spatiotemporally selected codons.

32. The polynucleotide of embodiment 29, further encoding a promoter, a linker, a signal peptide, a tag, a cleavage site and/or a targeting peptide.

33. A vector comprising a polynucleotide of any of embodiments 27-32.

34. The vector of embodiment 33, wherein the vector is a viral vector, or a plasmid.

35. The vector of embodiment 34, which is a viral vector and wherein the viral vector is a retroviral vector, a lentiviral vector, a gamma retroviral vector, a recombinant AAV vector, an adeno viral vector, or an oncolytic viral vector.

36. An immune cell for adoptive cell transfer (ACT), which expresses any of the compositions of any of embodiments 1-26, the polynucleotides of any of embodiments 27-32, and/or is infected or transfected with the vector of any of embodiments 33-35.

37. The immune cell of embodiment 36, wherein the immune cell is a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

38. The immune cell of embodiment 36, wherein the immune cell 49 which further expresses a composition comprising a second effector module, said second effector module comprising a second SRE linked to a second immunotherapeutic agent wherein the second immunotherapeutic agent is selected from a cytokine, and a cytokine-cytokine receptor fusion.

39. The immune cell of embodiment 38, wherein the second immunotherapeutic agent is a cytokine.

40. The immune cell of embodiment 39, wherein the cytokine is IL12 or IL15.

41. The immune cell of embodiment 38, wherein the second immunotherapeutic agent is a cytokine-cytokine receptor fusion polypeptide.

42. The immune cell of embodiment 41, wherein the cytokine-cytokine receptor fusion polypeptide is selected from a IL12-IL12 receptor fusion polypeptide, a IL15-IL15 receptor fusion polypeptide, and a IL15-IL15 receptor sushi domain fusion polypeptide.

43. The immune cell of embodiment 36 or 37, wherein the immune cell is autologous, allogeneic, syngeneic, or xenogeneic in relation to a particular individual subject.

44. A method of reducing a tumor volume or burden in a subject, comprising contacting said subject with a composition of any of embodiments 1-26, the polynucleotides of any of embodiments 27-32, the vectors of any of embodiments 33-35 or the immune cells of any of embodiments 36-43, wherein the SRE responds to a stimulus and regulates the expression and function of the immunotherapeutic agent.

45. A method of inducing an immune response in a subject comprising administering to the subject an effective amount of any of the compositions of embodiments 1-26, the polynucleotides of any of embodiments 27-32, the vectors of any of embodiments 33-35 or the immune cells of any of embodiments 36-43.

46. A method of identifying a domain of a CD19 antigen which will not bind the FMC63 antibody (FMC63-distinct CD19 binding domain), said method comprising: (a) preparing a composition comprising a CD19 antigen, (b) contacting the composition in (a) with saturating levels of FMC63 antibody, (c) contact the composition of step (b) with one or more selected members of a library of potential CD19 binders; and (d) identifying a binding domain on the CD19 antigen based on the differential binding of the selected members of the library of CD19 binders compared to the binding of FMC63.

47. The method of embodiment 46, wherein said binding domains of the library are generated using phage display techniques with the CD19 antigen as the seed sequence.

48. The method of embodiment 47, wherein the binding domain is selected from a Fab fragment, a Fab' fragment, F(ab)'2 fragment, a F(ab)'3 fragment, Fv, a single chain variable fragment (scFv), a bis-scFv, a (scFv)2, a minibody, a diabody, a triabody, a tetrabody, a disulfide stabilized Fv protein (dsFv), a unibody, a nanobody, or an antigen binding region of an antibody, and an antibody fragment.

49. The method of embodiment 48, wherein the CD19 antigen is selected from a whole or a portion of a human CD19 antigen, and a whole or a portion of a Rhesus CD19 antigen.

50. A chimeric antigen receptor comprising the FMC63-distinct CD19 binding domain obtained according to the method of any of embodiments 46-49.

51. An effector module comprising a stimulus response element (SRE) operably lined to the chimeric antigen receptor of embodiment 50.

In a further aspect, the biocircuits, stimulus response elements, compositions and methods are discussed further in the following embodiments.

1. A composition for inducing an immune response in a cell or a subject comprising an effector module, said effector module comprising a stimulus response element (SRE) operably linked to at least one payload, wherein said payload comprises an immunotherapeutic agent.

2. The composition of embodiment 1, wherein the immunotherapeutic agent is selected from the group consisting of a cytokine, a cytokine receptor, a cytokine-cytokine receptor fusion, and combinations thereof.

3. The composition of embodiment 2, wherein the SRE is responsive to or interacts with at least one stimulus.

4. The composition of embodiment 3, wherein the SRE comprises a destabilizing domain (DD).

5. The composition of embodiment 4, wherein the DD is derived from a parent protein or a mutant protein having one, two, three or more amino acid mutations compared to said parent protein, wherein the parent protein is selected from: (a) human protein FKBP, comprising the amino acid sequence of SEQ. ID NO. 7170; (b) human DHFR (hDHFR), comprising the amino acid sequence of SEQ. ID NO. 7171; (c) E. coli DHFR, comprising the amino acid sequence of SEQ. ID NO. 7172 (d) PDE5, comprising the amino acid sequence of SEQ. ID NO. 7173; (e) PPAR gamma comprising the amino acid sequence of SEQ. ID NO. 7174; (f) CA2, comprising the amino acid sequence of SEQ. ID NO. 7175; or (g) NQO2, comprising the amino acid sequence of SEQ. ID NO. 7176.

6. The composition of embodiment 5, wherein the parent protein is hDHFR and the DD comprises a mutant protein having: (a) a single mutation selected from hDHFR (I17V), hDHFR (F59S), hDHFR (N65D), hDHFR (K81R), hDHFR (A107V), hDHFR (Y122I), hDHFR (N127Y), hDHFR (M140I), hDHFR (K185E), hDHFR (N186D), hDHFR (M140I), hDHFR (Amino acid 2-187 of WT; N127Y), hDHFR (Amino acid 2-187 of WT; I17V), hDHFR (Amino acid 2-187 of WT; Y122I), and hDHFR (Amino acid 2-187 of WT; K185E); (b) a double mutation selected from hDHFR (C7R, Y163C), hDHFR (A10V, H88Y), hDHFR (Q36K, Y122I), hDHFR (M53T, R138I), hDHFR (T57A, I72A), hDHFR (E63G, I176F), hDHFR (G21T, Y122I), hDHFR (L74N, Y122I), hDHFR (V75F, Y122I), hDHFR (L94A, T147A), DHFR (V121A, Y22I), hDHFR (Y122I, A125F), hDHFR (H131R, E144G), hDHFR (T137R, F143L), hDHFR (Y178H, E181G), hDHFR (Y183H, K185E), hDHFR (E162G, I176F) hDHFR (Amino acid 2-187 of WT; I17V, Y122I), hDHFR (Amino acid 2-187 of WT; Y122I, M140I), hDHFR (Amino acid 2-187 of WT; N127Y, Y122I), hDHFR (Amino acid 2-187 of WT; E162G, I176F), and hDHFR (Amino acid 2-187 of WT; H131R, E144G), and hDHFR (Amino acid 2-187 of WT; Y122I, A125F); (c) a triple mutation selected from hDHFR (V9A, S93R, P150L), hDHFR (I8V, K133E, Y163C), hDHFR (L23S, V121A, Y157C), hDHFR (K19E, F89L, E181G), hDHFR (Q36F, N65F, Y122I), hDHFR (G54R, M140V, S168C), hDHFR (V110A, V136M, K177R), hDHFR (Q36F, Y122I, A125F), hDHFR (N49D, F59S, D153G), hDHFR (G21E, I72V, I176T), hDHFR (Amino acid 2-187 of WT; Q36F, Y122I, A125F), hDHFR (Amino acid 2-187 of WT; Y122I, H131R, E144G), hDHFR (Amino acid 2-187 of WT; E31D, F32M, V116I), and hDHFR (Amino acid 2-187 of WT; Q36F, N65F, Y122I); or (d) a quadruple or higher mutation selected from hDHFR (V2A, R33G, Q36R, L100P, K185R), hDHFR (Amino acid 2-187 of WT; D22S, F32M, R33S, Q36S, N65S), hDHFR (I17N, L98S, K99R, M112T, E151G, E162G, E172G), hDHFR (G16S, I17V, F89L, D96G, K123E, M140V, D146G, K156R), hDHFR (K81R, K99R, L100P, E102G, N108D, K123R, H128R, D142G, F180L, K185E), hDHFR (R138G, D142G, F143S, K156R, K158E, E162G, V166A, K177E, Y178C, K185E, N186S), hDHFR (N14S, P24S, F35L, M53T, K56E, R92G, S93G, N127S, H128Y, F135L, F143S, L159P, L160P, E173A, F180L), hDHFR (F35L, R37G, N65A, L68S, K69E, R71G, L80P, K99G, G117D, L132P, I139V, M140I, D142G, D146G, E173G, D187G), hDHFR (L28P, N30H, M38V, V44A, L68S, N73G, R78G, A97T, K99R, A107T, K109R, D111N, L134P, F135V, T147A, I152V, K158R, E172G, V182A, E184R), hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N).

7. The composition of embodiment 6, wherein the stimulus Trimethoprim (TMP) or Methotrexate (MTX).

8. The composition of embodiment 2, wherein the immunotherapeutic agent is a cytokine.

9. The composition of embodiment 8, wherein the cytokine is an interleukin, an interferon, a tumor necrosis factor, a transforming growth factor B, a CC chemokine, a CXC chemokine, a CX3C chemokine or a growth factor.

10. The composition of embodiment 9, wherein the interleukin is the whole or a portion of IL15 comprising the amino acid sequence of SEQ. ID NO. 7177.

11. The composition of embodiment 10, wherein SEQ. ID NO. 7177 is modified.

12. The composition of embodiment 11, wherein SEQ. ID NO. 7177 modification comprises: (a) fusing SEQ. ID NO. 7177 to the whole, or a portion, of a transmembrane protein, and (b) optionally, incorporating a hinge domain.

13. The composition of embodiment 2, wherein the immunotherapeutic agent is a cytokine-cytokine receptor fusion polypeptide.

14. The composition of embodiment 13, wherein the cytokine-cytokine receptor fusion polypeptide comprises the whole or a portion of SEQ. ID NO. 7177, fused to the whole or a portion of any of SEQ. ID NOs. 7178-7185 to produce a IL15-IL15 receptor fusion polypeptide.

15. The composition of embodiment 14, wherein the cytokine-cytokine receptor fusion polypeptide is modified.

16. The composition of embodiment 15, wherein cytokine-cytokine receptor fusion polypeptide modification comprises: (a) fusing the IL15-L15 receptor fusion polypeptide to the whole, or a portion, of a transmembrane protein, and (b) optionally, incorporating hinge domain.

17. The composition of embodiment 1, wherein the effector module is selected from a IL15-DD comprising the amino acid sequence of either of SEQ. ID NOs. 7186-7189, or 7190 and an IL15/IL15Ra fusion-DD comprising the amino acid sequence of any of SEQ. ID NOs. 7191-7203, 7681, 7204-7219, or 7220.

18. The composition of embodiment 17, wherein the SRE stabilizes the immunotherapeutic agent by a stabilization ratio of 1 or more, wherein the stabilization ratio comprises the ratio of expression, function or level of the immunotherapeutic agent in the presence of the stimulus to the expression, function or level of the immunotherapeutic agent in the absence of the stimulus.

19. The composition of any of embodiments 17-18, wherein the SRE destabilizes the immunotherapeutic agent by a destabilization ratio between 0, and 0.09, wherein the destabilization ratio comprises the ratio of expression, function or level of an immunotherapeutic agent in the absence of the stimulus specific to the SRE to the expression, function or level of the immunotherapeutic agent that is expressed constitutively, and in the absence of the stimulus specific to the SRE.

20. A polynucleotide encoding any of the compositions of embodiments 1-19.

21. The polynucleotide of embodiment 20, which is a DNA molecule, or an RNA molecule.

22. The polynucleotide of embodiment 21, wherein the polynucleotide comprises spatiotemporally selected codons.

23. The polynucleotide of embodiment 21 which is a DNA molecule.

24. The polynucleotide of embodiment 21, wherein the polynucleotide is an RNA molecule and said RNA molecule is a messenger RNA.

25. The polynucleotide of embodiment 24, wherein the polynucleotide is chemically modified.

26. The polynucleotide of embodiment 23 or 24, wherein the polynucleotide further comprises at least one additional feature selected from a promoter, a linker, a signal peptide, a tag, a cleavage site and a targeting peptide.

27. A vector comprising a polynucleotide of embodiment 20.

28. The vector of embodiment 27, wherein the vector is a viral vector, or a plasmid.

29. The vector of embodiment 28, wherein the viral vector is a viral vector selected from the group consisting of a retroviral vector, a lentiviral vector, a gamma retroviral vector, a recombinant AAV vector, an adeno viral vector, and an oncolytic viral vector.

30. An immune cell for adoptive cell transfer (ACT) which expresses any of the compositions of any of embodiments 1-19, the polynucleotides of any of embodiments 20-26 and/or is infected or transfected with the vector of any of embodiments 27-29.

31. The immune cell of embodiment 30, selected from a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

32. The immune cell of embodiment 30, which is autologous, allogeneic, syngeneic, or xenogeneic in relation to a particular individual subject.

33. A method of reducing a tumor volume or burden in a subject in need thereof, comprising contacting said subject with the immune cells of any of embodiments 30-32.

34. A method of inducing an anti-tumor immune response in a subject comprising administering to the subject an effective amount of the immune cells of any of embodiments 30-32.

35. A method of enhancing the expansion and/or survival of immune cells comprising contacting the immune cells with the compositions of any of embodiments 1-19, the polynucleotides of any of embodiments 20-26 and/or the vector of any of embodiments 27-29, wherein the SRE responds to a stimulus and regulates the expression and function of the immunotherapeutic agent, thereby enhancing the expansion and/or survival of the immune cells.

36. The method of embodiment 35, wherein the contacted immune cell is selected from a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

37. A method of inducing an immune response in a subject comprising administering to the subject an effective amount of any of the compositions of embodiments 1-19, any of the polynucleotides of embodiments 20-26, any of the vectors of embodiments 27-29, or any of the immune cells of embodiments 30-32.

In a further aspect, the biocircuits, stimulus response elements, compositions and methods are discussed further in the following embodiments.

1. A composition for inducing an immune response in a cell or a subject comprising a first effector module, said first effector module comprising a first stimulue response element (SRE) operably linked to a first payload, wherein said first payload comprises an immunotherapeutic agent.

2. The composition of embodiment 1, wherein the immunotherapeutic agent is a cytokine.

3. The composition of embodiment 2, wherein the first SRE is responsive to or interacts with at least one stimulus.

4. The composition of embodiment 3, wherein the first SRE is a first destabilizing domain (DD).

5. The composition of embodiment 4, wherein the first DD is derived from a parent protein or a mutant protein having one, two, three or more amino acid mutations compared to said parent protein, wherein the parent protein is selected from: (a) human protein FKBP, comprising the amino acid sequence of SEQ ID NO. 7221; (b) human DHFR (hDHFR), comprising the amino acid sequence of SEQ ID NO. 7222; (c) E. Coli DHFR, comprising the amino acid sequence of SEQ ID NO. 7223; (d) PDE5, comprising the amino acid sequence of SEQ ID NO. 7224; (e) PPAR, gamma comprising the amino acid sequence of SEQ ID NO. 7225; (f) CA2, comprising the amino acid sequence of SEQ ID NO. 7226; or (g) NQO2, comprising the amino acid sequence of SEQ ID NO. 7227.

The composition of embodiment 5, wherein the parent protein is hDHFR and the first DD comprises a mutant protein having:
(a) a single mutation selected from hDHFR (I17V), hDHFR (F59S), hDHFR (N65D), hDHFR (K81R), hDHFR (A107V), hDHFR (Y122I), hDHFR (N127Y), hDHFR (M140I), hDHFR (K185E), hDHFR (N186D), and hDHFR (M140I), hDHFR (Amino acid 2-187 of WT; N127Y), hDHFR (Amino acid 2-187 of WT; I17V), hDHFR (Amino acid 2-187 of WT; Y122I), and hDHFR (Amino acid 2-187 of WT; K185E);
(b) a double mutation selected from hDHFR (C7R, Y163C), hDHFR (A10V, H88Y), hDHFR (Q36K, Y122I), hDHFR (M53T, R138I), hDHFR (T57A, I72A), hDHFR (E63G, I176F), hDHFR (G21T, Y122I), hDHFR (L74N, Y122I), hDHFR (V75F, Y122I), hDHFR (L94A, T147A), DHFR (V121A, Y22I), hDHFR (Y122I, A125F), hDHFR (H131R, E144G), hDHFR (T137R, F143L), hDHFR (Y178H, E181G), and hDHFR (Y183H, K185E), hDHFR (E162G, I176F) hDHFR (Amino acid 2-187 of WT; I17V, Y122I), hDHFR (Amino acid 2-187 of WT; Y122I, M140I), hDHFR (Amino acid 2-187 of WT; N127Y, Y122I), hDHFR (Amino acid 2-187 of WT; E162G, I176F), and hDHFR (Amino acid 2-187 of WT; H131R, E144G), and hDHFR (Amino acid 2-187 of WT; Y122I, A125F); or
(c) a triple mutation selected from hDHFR (V9A, S93R, P150L), hDHFR (I8V, K133E, Y163C), hDHFR (L23S, V121A, Y157C), hDHFR (K19E, F89L, E181G), hDHFR (Q36F, N65F, Y122I), hDHFR (G54R, M140V, S168C), hDHFR (V110A, V136M, K177R), hDHFR (Q36F, Y122I, A125F), hDHFR (N49D, F59S, D153G), and hDHFR (G21E, I72V, I176T), hDHFR (Amino acid 2-187 of WT; Q36F, Y122I, A125F), hDHFR (Amino acid 2-187 of WT; Y122I, H131R, E144G), hDHFR (Amino acid 2-187 of WT; E31D, F32M, V116I), and hDHFR (Amino acid 2-187 of WT; Q36F, N65F, Y122I); or
(d) a quadruple or higher mutation selected from hDHFR (V2A, R33G, Q36R, L100P, K185R), hDHFR (Amino acid 2-187 of WT; D22S, F32M, R33S, Q36S, N65S), hDHFR (I17N, L98S, K99R, M112T, E151G, E162G, E172G), hDHFR (G16S, I17V, F89L, D96G, K123E, M140V, D146G, K156R), hDHFR (K81R, K99R, L100P, E102G, N108D, K123R, H128R, D142G, F180L, K185E), hDHFR (R138G, D142G, F143S, K156R, K158E, E162G, V166A, K177E, Y178C, K185E, N186S), hDHFR (N14S, P24S, F35L, M53T, K56E, R92G, S93G, N127S, H128Y, F135L, F143S, L159P, L160P, E173A, F180L), hDHFR (F35L, R37G, N65A, L68S, K69E, R71G, L80P, K99G, G117D, L132P, I139V, M140I, D142G, D146G, E173G, D187G), hDHFR (L28P, N30H, M38V, V44A, L68S, N73G, R78G, A97T, K99R, A107T, K109R, D111N, L134P, F135V, T147A, I152V, K158R, E172G, V182A, E184R), hDHFR (V2A, I17V, N30D, E31G, Q36R, F59S, K69E, I72T, H88Y, F89L, N108D, K109E, V110A, I115V, Y122D, L132P, F135S, M140V, E144G, T147A, Y157C, V170A, K174R, N186S), hDHFR (L100P, E102G, Q103R, P104S, E105G, N108D, V113A, W114R, Y122C, M126I, N127R, H128Y, L132P, F135P, I139T, F148S, F149L, I152V, D153A, D169G, V170A, I176A, K177R, V182A, K185R, N186S), and hDHFR (A10T, Q13R, N14S, N20D, P24S, N30S, M38T, T40A, K47R, N49S, K56R, I61T, K64R, K69R, I72A, R78G, E82G, F89L, D96G, N108D, M112V, W114R, Y122D, K123E, I139V, Q141R, D142G, F148L, E151G, E155G, Y157R, Q171R, Y183C, E184G, K185del, D187N).

7. The composition of embodiment 6, wherein the stimulus is selected from Trimethoprim (TMP) and Methotrexate (MTX).

8. The composition of embodiment 2, wherein the cytokine is an interleukin, an interferon, a tumor necrosis factor, a transforming growth factor B, a CC chemokine, a CXC chemokine, a CX3C chemokine or a growth factor.

9. The composition of embodiment 8, wherein the interleukin is selected from IL1, IL1-alpha, IL1-beta, IL1-delta, IL1-epsilon, IL1-eta, L-zeta, ILRA, IL2, L3, IL4, IL5, IL6, IL7, IL8, IL9, IL10, IL10C, IL10D, IL11a, IL11b, IL12, IL13, IL14, IL15, IL16, IL17, IL17A, IL17B, IL17C, IL17E, IL17F, IL18, IL19, IL20, IL20L, IL21, IL22, IL23, IL23A, IL24, IL25, IL26, IL27, IL28, IL29, IL30, IL31, IL32, IL33, IL34, IL36α, IL36β, IL36γ, IL36RN, IL37, IL37a, IL37b, L37c, I137d, L37e, and L38.

10. The composition of embodiment 9, wherein the interleukin is the whole or a portion of IL12.

11. The composition of embodiment 10, wherein the IL12 comprises a p40 subunit of SEQ ID NO. 7228, appended to a p35 subunit of SEQ ID NO. 7229.

12. The composition of any of embodiments 1-11, wherein said first effector module comprises the amino acid sequence of any of SEQ ID NO. 7230-7238 and 7239.

13. The composition of any of embodiments 1-12, further comprising a second effector module, said second effector module comprising a second SRE linked to an immunotherapeutic agent.

14. The composition of embodiment 13, wherein the immunotherapeutic agent is a cytokine selected from an IL15 and an IL15/IL15Ra fusion polypeptide.

15. The composition of any of embodiments 1-14, wherein said first SRE stabilizes the immunotherapeutic agent by a stabilization ratio of 1 or more, wherein the stabilization ratio comprises the ratio of expression, function or level of the immunotherapeutic agent in the presence of the stimulus to the expression, function or level of the immunotherapeutic agent in the absence of the stimulus.

16. The composition of any of embodiments 1-14, wherein said first SRE destabilizes the immunotherapeutic agent by a destabilization ratio between 0, and 0.09, wherein the destabilization ratio comprises the ratio of expression, function or level of the immunotherapeutic agent in the absence of the stimulus specific to said first SRE to the expression, function or level of the immunotherapeutic agent that is expressed constitutively, and in the absence of the stimulus specific to sad first SRE.

17. A polynucleotide encoding either or both of said first and said second effector modules of any of embodiments 1-14.

18. The polynucleotide of embodiment 17, which is a DNA molecule, or a RNA molecule.

19. The polynucleotide of embodiment 18, wherein the polynucleotide is an RNA molecule and said RNA molecule is a messenger RNA.

20. The polynucleotide of embodiment 19, wherein the polynucleotide is chemically modified.

21. The polynucleotide of embodiment 18, which is a DNA molecule.

22. The polynucleotide of embodiment 18, wherein the polynucleotide comprises spatiotemporally selected codons.

23. The polynucleotide of embodiment 18, wherein the polynucleotide further comprises at least one additional feature selected from a promoter, a linker, a signal peptide, a tag, and a targeting peptide.

24. A vector comprising a polynucleotide of embodiment 17.

25. The vector of embodiment 24, wherein the vector is a viral vector, or a plasmid.

26. The vector of embodiment 25, which is a viral vector and said viral vector is a retroviral vector, a lentiviral vector, a gamma retroviral vector, a recombinant AAV vector, an adeno viral vector, or an oncolytic viral vector.

27. The vector of embodiment 26, wherein the polynucleotide is optionally placed under the transcriptional control of a promoter.

28. The vector of embodiment 27, wherein the promoter is selected from a CMV promoter, an EF1a promoter and a PGK promoter.

29. The vector of embodiment 28, wherein the promoter is an EF1a promoter.

30. An immune cell for adoptive cell transfer (ACT), which expresses any of the compositions of any of embodiments 1-16, the polynucleotides of any of embodiments 17-23, and/or is infected or transfected with the vector of any of embodiments 24-29.

31. The immune cell of embodiment 29, selected from a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

32. The immune cell of embodiment 31, which is autologous, allogeneic, syngeneic, or xenogeneic in relation to a particular individual subject.

33. A method of reducing a tumor volume or burden in a subject in need thereof, comprising contacting said subject with the immune cells of any of embodiments 30-32.

34. A method of inducing an anti-tumor immune response in a subject comprising contacting contacting said subject with the immune cells of any of embodiments 30-32.

35. The method of embodiment 34, wherein the immune cell is selected from a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof.

36. A method of inducing an immune response in a subject comprising administering to the subject an effective amount of any of the compositions of embodiments 1-16, the polynucleotides of any of embodiments 17-23, the vectors of any of embodiments 24-29, or any of the cells of embodiments 30-32.

37. A method for pulsatile regulation of an immunotherapeutic agent in a cell or a subject comprising the steps of (a) contacting the cell or subject with an effective amount of the composition of any of embodiments 1-16, wherein said first SRE responds to a stimulus and regulates the expression and function of the immunotherapeutic agent; and (b) administering the stimulus to the cell or subject, followed by the withdrawal of the stimulus at selected time intervals, thereby achieving pulsatile regulation of the immunotherapeutic agent.

In a further aspect, the biocircuits, stimulus response elements, compositions and methods are discussed further in the following embodiments.

1. A composition for inducing an immune response in a cell or a subject comprising a first effector module, said effector module comprising a first stimulus response element (SRE) operably linked to at least one immunotherapeutic agent, wherein said at least one immunotherapeutic agent is selected from a cytokine, a safety switch, a regulatory switch, a chimeric antigen receptor and combinations thereof.

2. The composition of embodiment 1, wherein said first SRE is responsive to or interacts with at least one stimulus.

3. The composition of embodiment 2, wherein said first SRE is a destabilizing domain (DD).

4. The composition of embodiment 3, wherein the DD is derived from a parent protein or a mutant protein having one, two, three or more amino acid mutations compared to said parent protein, wherein the parent protein is selected from:

(a) human protein FKBP comprising the amino acid sequence of SEQ ID NO. 7240, (b) human DHFR (hDHFR) comprising the amino acid sequence of SEQ ID NO. 7241, (c) *E. coli* DHFR (ecDHFR) comprising the amino acid sequence of SEQ ID NO. 7242, (d) PDE5 comprising the amino acid sequence of SEQ ID NO. 7243, (e) PPAR gamma comprising the amino acid sequence of SEQ ID NO. 7244, (f) CA2 comprising the amino acid sequence of SEQ ID NO. 7245, (g) NQO2 comprising the amino acid sequence of SEQ ID NO. 7246, and (h) human DPPIV comprising the amino acid sequence of SEQ ID NO. 7247.

5. The composition of embodiment 4, wherein the parent protein is hDHFR and the DD comprises a mutant protein having at least one mutation selected from M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

6. The composition of embodiment 5, wherein the stimulus is selected from Trimethoprim (TMP) and Methotrexate (MTX).

7. The composition of embodiment 1, wherein the immunotherapeutic agent is a cytokine.

8. The composition of embodiment 7, wherein the cytokine is an interleukin, an interferon, a tumor necrosis factor, a transforming growth factor B, a CC chemokine, a CXC chemokine, a CX3C chemokine or a growth factor.

9. The composition of embodiment 8, wherein the cytokine is an interleukin and the interleukin is selected from a group consisting of IL1, IL1-alpha, IL1-beta, L1-delta, IL1-epsilon, L1-eta, L1-zeta, IL-RA, IL2, IL3, IL4, IL5, IL6, IL7, IL8, IL9, IL10, IL10C, IL10D, IL11a, IL11b, IL13, IL14, IL16, IL17, IL-17A, IL17B, IL17C, IL17E, IL17F, IL18, IL19, IL20, IL20L, IL21, IL22, IL23, IL23A, IL24, IL25, IL26, IL27, IL28, IL29, IL30, IL31, IL32, IL33, IL34, IL36α, IL36β, IL36γ, IL36RN, IL37, IL37a, IL37b, IL37c, 1137d, IL37e, and IL38.

10. The composition of embodiment 9, wherein the interleukin is IL2, comprising the amino acid sequence of SEQ ID NO. 7248.

11. The composition of embodiment 1, wherein the immunotherapeutic agent is a safety switch.

12. The composition of embodiment 11, wherein the safety switch is selected from a Caspase 9, an inducible FAS (iFAS), an inducible caspase 9 (icasp9), a CD20/anti-CD20 antibody pair, a protein tag/anti-tag antibody, and a compact suicide gene (RQR8).

13. The composition of embodiment 12, wherein the safety switch is a Caspase 9 comprising the amino acid sequence of SEQ ID NO. 7249.

14. The composition of embodiment 1, wherein the immunotherapeutic agent encodes a regulatory switch.

15. The composition of embodiment 14, wherein the regulatory switch is selected from a FOXP3, a Nr4a, a FOXO, and a NF-D B.

16. The composition of embodiment 15, wherein the regulatory switch is a FOXP3, comprising the amino acid sequence of SEQ ID NO. 7250-7253.

17. The composition of embodiment 1, wherein the immunotherapeutic agent is a chimeric antigen receptor (CAR) and is selected from a GD2 CAR, a Her2 CAR, a BCMA CAR, a CD33 CAR, an ALK CAR, a CD22 CAR, and a CD276 CAR, each of which comprises an extracellular moiety, a transmembrane domain, an intracellular signaling domain, and optionally, one or more co-stimulatory domains.

18. The composition of embodiment 17, wherein the CAR is designed as a standard CAR, a split CAR, an off-switch CAR, an on-switch CAR, a first-generation CAR, a second-generation CAR, a third-generation CAR, or a fourth-generation CAR.

19. The composition of embodiment 18, wherein the extracellular target moiety is selected from any of:
an Ig NAR,
a Fab fragment,
a Fab' fragment,
a F(ab)'2 fragment,
a F(ab)'3 fragment,
an Fv,
a single chain variable fragment (scFv),
a bis-scFv, a (scFv)2,
a minibody,
a diabody,
a triabody,
a tetrabody,
an intrabody,
a disulfide stabilized Fv protein (dsFv),
a unibody,
a nanobody, and
an antigen binding region derived from an antibody that specifically binds to any of a protein of interest, a ligand, a receptor, a receptor fragment or a peptide aptamer.

20. The composition of embodiment 17, wherein the extracellular target moiety is selected from an ALK target moiety, comprising the amino acid sequence of SEQ ID NO. 7254-7269 and 7270, 424-429 and 2739, a CD22 target moiety, comprising the amino acid sequence of SEQ ID NO. 7276-7280 and 7281-7283, a CD276 target moiety, comprising the amino acid sequence of SEQ ID NO. 7284-7291 and 7292-7295, a GD2 target moiety, comprising the amino acid sequence of SEQ ID NO. 7296-7374 and 7375-7403, a CD33 target moiety, comprising the amino acid sequence of SEQ ID NO. 7404-7411, a BCMA target moiety, comprising the amino acid sequence of SEQ ID NO. 7412-7419, and a Her2 target moiety, comprising the amino acid sequence of SEQ ID NO. 7420-7575 and 7476-7483.

21. The composition of embodiment 17, wherein
(a) the intracellular signaling domain of the CAR is the signaling domain derived from T cell receptor CD3zeta or a cell surface molecule selected from the group consisting of FcR gamma, FcR beta, CD3 gamma, CD3 delta, CD3 epsilon, CD5, CD22, CD79a, CD79b, and CD66d; and
(b) the co-stimulatory domain is present and is selected from the group consisting of 2B4, HVEM, ICOS, LAG3, DAP10, DAP12, CD27, CD28, 4-1BB (CD137), OX40 (CD134), CD30, CD40, ICOS (CD278), glucocorticoid-induced tumor necrosis factor receptor (GITR), lymphocyte function-associated antigen-1 (LFA-1), CD2, CD7, LIGHT, NKG2C, and B7-H3.

22. The composition of embodiment 17, wherein the transmembrane domain comprises the amino acid sequence of SEQ ID NO. 7484-7581.

23. The composition of embodiment 17, wherein the transmembrane domain further comprises a hinge region comprising the amino acid sequence of SEQ ID NO. 628-633, 635-694 and 2741.

24. The composition of any of embodiments 1-23 wherein said first effector module comprises one or more of:
(a) an IL2-DD, comprising the amino acid sequence of any of SEQ ID NOs. 7646-7648,
(b) a Caspase 9-DD, comprising the amino acid sequence of any of SEQ ID NOs. 7649-7657,
(c) a FOXP3-DD, comprising the amino acid sequence of any of SEQ ID NOs. 7658-7667,
(d) a BCMA CAR-DD, comprising the amino acid sequence of any of SEQ ID NOs. 7668-7670, and
(e) a HER2-DD, comprising the amino acid sequence of SEQ ID NO. 7671.

25. A polynucleotide encoding any of the compositions of embodiments 1-24, wherein said at least one immunotherapeutic agent is selected from a cytokine, a safety switch, a regulatory switch, a chimeric antigen receptor and the combination thereof.

26. The polynucleotide of embodiment 25, wherein the polynucleotide is a DNA molecule, or a RNA molecule.

27. The polynucleotide of embodiment 26, wherein the polynucleotide is RNA and said RNA is a messenger RNA.

28. The polynucleotide of embodiment 27, which is chemically modified.

29. The polynucleotide of embodiment 26, which comprises spatiotemporally selected codons.

30. The polynucleotide of embodiment 27, wherein the polynucleotide encodes at least one additional feature selected from a promoter, a linker, a signal peptide, a tag, a cleavage site and a targeting peptide.

31. The polynucleotide of embodiment 25, wherein the chimeric antigen receptor is selected from a GD2 CAR, a Her2 CAR, a BCMA CAR, a CD33 CAR, an ALK CAR, CD22 CAR, and a CD276 CAR.

32. A vector comprising a polynucleotide of any of embodiments 25-31 wherein said at least one immunotherapeutic agent is selected from a cytokine, a safety switch, a regulatory switch, a chimeric antigen receptor and the combination thereof.

33. The vector of embodiment 32, wherein the vector is a viral vector, or a plasmid.

34. The vector of embodiment 33, wherein the vector is a viral vector and said viral vector is a retroviral vector, a lentiviral vector, a gamma retroviral vector, a recombinant AAV vector, an adeno viral vector, or an oncolytic viral vector.

35. The vector of embodiment 34, wherein the polynucleotide encodes any of the compositions of embodiment 1-24.

36. An immune cell for adoptive cell transfer (ACT), which expresses any of the compositions of any of embodiments 1-24, the polynucleotides of any of embodiments 25-31, and/or is infected or transfected with the vector of any of embodiments 32-35.

37. The immune cell of embodiment 36, wherein the immune cell is a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell, a human embryonic stem cell, a mesenchymal stem cell, a hematopoietic stem cell, or a mixture thereof. 38. The immune cell of embodiment 36, wherein the SRE is a destabilizing domain DD, wherein the DD is derived from human protein FKBP comprising the amino acid sequence of SEQ ID NO. 7672, DHFR comprising the amino acid sequence of SEQ ID NO. 7673, 7674, PDE5 comprising the amino acid sequence of SEQ ID NO. 7675, PPAR gamma comprising the amino acid sequence of SEQ ID NO. 7676, CA2 comprising the amino acid sequence of SEQ ID NO. 7677 and NQO2 comprising the amino acid sequence of SEQ ID NO. 7678.

39. The immune cell of embodiment 38, wherein the DD is derived from a parent protein and the parent protein is hDHFR and the DD comprises a mutant protein having at least one mutation selected from M1del, V2A, C7R, I8V, V9A, A10T, A10V, Q13R, N14S, G16S, I17N, I17V, K19E, N20D, G21T, G21E, D22S, L23S, P24S, L28P, N30D, N30H, N30S, E31G, E31D, F32M, R33G, R33S, F35L, Q36R, Q36S, Q36K, Q36F, R37G, M38V, M38T, T40A, V44A, K47R, N49S, N49D, M53T, G54R, K56E, K56R, T57A, F59S, I61T, K64R, N65A, N65S, N65D, N65F, L68S, K69E, K69R, R71G, I72T, I72A, I72V, N73G, L74N, V75F, R78G, L80P, K81R, E82G, H88Y, F89L, R92G, S93G, S93R, L94A, D96G, A97T, L98S, K99G, K99R, L100P, E102G, Q103R, P104S, E105G, A107T, A107V, N108D, K109E, K109R, V110A, D111N, M112T, M112V, V113A, W114R, I115V, V116I, G117D, V121A, Y122C, Y122D, Y122I, K123R, K123E, A125F, M126I, N127R, N127S, N127Y, H128R, H128Y, H131R, L132P, K133E, L134P, F135P, F135L, F135S, F135V, V136M, T137R, R138G, R138I, I139T, I139V, M140I, M140V, Q141R, D142G, F143S, F143L, E144G, D146G, T147A, F148S, F148L, F149L, P150L, E151G, I152V, D153A, D153G, E155G, K156R, Y157R, Y157C, K158E, K158R, L159P, L160P, E162G, Y163C, V166A, S168C, D169G, V170A, Q171R, E172G, E173G, E173A, K174R, I176A, I176F, I176T, K177E, K177R, Y178C, Y178H, F180L, E181G, V182A, Y183C, Y183H, E184R, E184G, K185R, K185del, K185E, N186S, N186D, D187G, and D187N.

40. The immune cell of embodiment 39, which is autologous, allogeneic, syngeneic, or xenogeneic in relation to a particular individual subject.

41. A method of reducing a tumor volume or burden in a subject comprising contacting the subject with compositions of any of embodiments 1-24, the polynucleotides of any of embodiments 25-31, the vector of any of embodiments 32-35 or the immune cells of any of embodiments 36-40.

42. A method of providing an anti-tumor immune response in a subject comprising administering to the subject an effective amount of the compositions of any of embodiments 1-24, the polynucleotides of any of embodiments 25-31, the vector of any of embodiments 32-35 or the immune cells of any of embodiments 36-40.

43. A method of inducing an immune response in a subject comprising administering to the subject an effective amount of any of the compositions of embodiments 1-24, the polynucleotides of any of embodiments 25-31, the vector of any of embodiments 32-35 or the immune cells of any of embodiments 36-40.

44. A method of preventing or reversing T cell exhaustion in a subject in need thereof, the method comprising administering to the subject, a therapeutically effective amount of compositions of any of embodiments 1-24, the polynucleotides of any of embodiments 25-31, the vector of any of embodiments 32-35 or the immune cells of any of embodiments 36-40, wherein the SRE responds to a stimulus and tunes the expression and/or function of the immunotherapeutic agent, thereby preventing or reversing T cell exhaustion.

45. The method of embodiment 44, wherein the immunotherapeutic agent is a chimeric antigen receptor.

46. The method of embodiment 45, wherein the chimeric antigen receptor is a GD2 CAR, BCMA CAR, CD33 CAR, Her2 CAR, ALK CAR, CD22 CAR, or a CD276 CAR.

47. A method of detecting the presence of cancer in a mammal, comprising the steps of:
(a) contacting a sample comprising one or more cells from the mammal with the compositions of any of embodiments 1-24, the polynucleotides of any of embodiments 25-31, the vector of any of embodiments 32-35 or the immune cells of any of embodiments 36-40 and
(b) detecting the complex, wherein the detection of the complex is indicative of the presence of cancer in the mammal.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (7681 sequences)

SEQ ID NO: 1 - protein, 187 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 2 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELVNKVDMVWIVGGSSVYKEAMNHPGHLKLFVTRIMQDFESDTFFPEIDLEKYKLLPEYPGVLSDVQEEKGIKYKFEVYEKND

SEQ ID NO: 3 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWSSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 4 - protein, 187 aa, Artificial Sequence
  Description of Artificial Sequence: Synthetic destabilizing domain (DD)
MVGSLNCIVAVSQNMGVGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 5 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEEND

SEQ ID NO: 6 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELREPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 7 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIIQDFESDTFFPEIDLEKYKLLPEYPGVLSDVQEEKGIKYKFEVYEKND

SEQ ID NO: 8 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMYHPGHLKLFVTRIMQDFESDTFFPEIDLEKYKLLPEYPGVLSDVQEEKGIKYKFEVYEKND

SEQ ID NO: 9 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKDD

SEQ ID NO: 10 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKDRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 11 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 12 - protein, 187 aa, Artificial Sequence
  Description of Artificial Sequence: Synthetic destabilizing domain (DD)
MVGSLNCIVVVSQNMGIGKNGDLPWPPLRNEFRYFQRMTTTSSVEGKQNLVIMGKKTWFSIPEKNRPLKGRINLVLSRELKEPPQGAYFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 13 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 14 - protein, 187 aa, Artificial Sequence
  Description of Artificial Sequence: Synthetic destabilizing domain (DD)
MVGSLNRIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPECPGVLSDVQEEKGIKYKFEVYEKND

SEQ ID NO: 15 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPGYPGVLSDVQEEKGFKYKFEVYEKND

SEQ ID NO: 16 - protein, 187 aa, Artificial Sequence
  Description of Artificial Sequence: Synthetic destabilizing domain (DD)
MVGSLNCIVAVSQNMGIGKNTDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 17 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGRLKLFVTRIMQDFGSDTFFPEIDLEKYKLLPEYPGVLSDVQEEKGIKYKFEVYEKND

SEQ ID NO: 18 - protein, 187 aa, Artificial Sequence
  Description of Artificial Sequence: Synthetic destabilizing domain (DD)
MVGSLNCIVAVSQNMGVGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 19 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINNVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 20 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSADDALKLTEQPELANKVDMVWIVGGSSVYKEAMNHPGHLKLFVTRIMQDFESDAFFPEIDLEKYKLLPEYPGVLSDVQEEKGIKYKFEVYEKND

SEQ ID NO: 21 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVITGKKTWFSIPEKNRPLKGRINLVLSRELKEPPQGAHFLSRSLDDALKLTEQPELANKVDMVWIVGGSSVYKEAMNHPGHLKLFVTIIMQDFESDTFFPEIDLEKYKLLPEYPGVLSDVQEEKGIKYKFEVYEKND

SEQ ID NO: 22 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMYHPGHLKLFVTRIMQDFESDTFFPEIDLEKYKLLPEYPGVLSDVQEEKGIKYKFEVYEKND

SEQ ID NO: 23 - protein, 187 aa, Artificial Sequence
  Description of Artificial Sequence: Synthetic destabilizing domain (DD)
MVGSLNCIVAVSQNMGIGKNGDLPWPPLRNEFRYFKRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 24 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVRRIMQDLESDTFFPEIDLEKYKLLPEYPGVLSDVQEEKGIKYKFEVYEKND

SEQ ID NO: 25 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKAWFSIPEKNRPLKGRANLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 26 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSAIKEAMNHPGHLKLFVTRIMQDFESDTFFPEIDLEKYKLLPEYPGVLSDVQEEKGIKYKFEVYEKND

SEQ ID NO: 27 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLFLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 28 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKND

SEQ ID NO: 29 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIIQDFESDTFFPEIDLEKYKLLPEYPGVLSDVQEEKGIKYKFEVYEKND

SEQ ID NO: 30 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKHKFGVYEKND

SEQ ID NO: 31 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVHEEND

SEQ ID NO: 32 - protein, 186 aa, Artificial Sequence
  Description of Artificial Sequence: Synthetic destabilizing domain (DD)
VGSLNCIVAVSQNMGIGKNTDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 33 - protein, 186 aa, Artificial Sequence
  Description of Artificial Sequence: Synthetic destabilizing domain (DD)
VGSLNCIVAVSQNMGVGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 34 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINNVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 35 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSADDALKLTEQPELANKVDMVWIVGGSSVYKEAMNHPGHLKLFVTRIMQDFESDAFFPEIDLEKYKLLPEYPGVLSDVQEEKGIKYKFEVYEKND

SEQ ID NO: 36 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVITGKKTWFSIPEKNRPLKGRINLVLSRELKEPPQGAHFLSRSLDDALKLTEQPELANKVDMVWIVGGSSVYKEAMNHPGHLKLFVTIIMQDFESDTFFPEIDLEKYKLLPEYPGVLSDVQEEKGIKYKFEVYEKND

SEQ ID NO: 37 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMYHPGHLKLFVTRIMQDFESDTFFPEIDLEKYKLLPEYPGVLSDVQEEKGIKYKFEVYEKND

SEQ ID NO: 38 - protein, 186 aa, Artificial Sequence
  Description of Artificial Sequence: Synthetic destabilizing domain (DD)
VGSLNCIVAVSQNMGIGKNGDLPWPPLRNEFRYFKRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 39 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSAIKEAMNHPGHLKLFVTRIMQDFESDTFFPEIDLEKYKLLPEYPGVLSDVQEEKGIKYKFEVYEKND

SEQ ID NO: 40 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLFLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 41 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKND

SEQ ID NO: 42 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIIQDFESDTFFPEIDLEKYKLLPEYPGVLSDVQEEKGIKYKFEVYEKND

SEQ ID NO: 43 - protein, 187 aa, Artificial Sequence
  Description of Artificial Sequence: Synthetic destabilizing domain (DD)
MVGSLNCIVAVSQNMGIGKNGDLPWPPLRNDMRYFQRMTTTSSVEGKQNLVIMGKKTWFSIPEKNRPLKGRINLVLSRELKEPPQGAHFLSRSLDDALKLTEQPELANKVDMVWIIGGSSVYKEAMNHPGHLKLFVTRIMQDFESDTFFPEIDLEKYKLLPEYPGVLSDVQEEKGIKYKFEVYEKND

SEQ ID NO: 44 - protein, 187 aa, Artificial Sequence
  Description of Artificial Sequence: Synthetic destabilizing domain (DD)
MVGSLNCIVAVSQNMGIGKNEDLPWPPLRNEFRYFQRMTTTSSVEGKQNLVIMGKKTWFSIPEKNRPLKGRVNLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGTKYKFEVYEKND

SEQ ID NO: 45 - protein, 187 aa, Artificial Sequence
  Description of Artificial Sequence: Synthetic destabilizing domain (DD)
MVGSLNCVVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLELFVTRIMQDFESDTFFPEIDLEKYKLLPECPGVLSDVQEEKGIKYKFEVYEKND

SEQ ID NO: 46 - protein, 187 aa, Artificial Sequence
  Description of Artificial Sequence: Synthetic destabilizing domain (DD)
MVGSLNCIVAVSQNMGIGENGDLPWPPLRNEFRYFQRMTTTSSVEGKQNLVIMGKKTWFSIPEKNRPLKGRINLVLSRELKEPPQGAHLLSRSLDDALKLTEQPELANKVDMVWIVGGSSVYKEAMNHPGHLKLFVTRIMQDFESDTFFPEIDLEKYKLLPEYPGVLSDVQEEKGIKYKFGVYEKND

SEQ ID NO: 47 - protein, 187 aa, Artificial Sequence
  Description of Artificial Sequence: Synthetic destabilizing domain (DD)
MVGSLNCIVAVSQNMGIGKNGDSPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSAYKEAMNHPGHLKLFVTRIMQDFESDTFFPEIDLEKCKLLPEYPGVLSDVQEEKGIKYKFEVYEKND

SEQ ID NO: 48 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQDLVIMGKKTWSSIPEKNRPLKGRINLVLSRELKEPPQGAHFLSRSLDDALKLTEQPELANKVDMVWIVGGSSVYKEAMNHPGHLKLFVTRIMQDFESDTFFPEIGLEKYKLLPEYPGVLSDVQEEKGIKYKFEVYEKND

SEQ ID NO: 49 - protein, 187 aa, Artificial Sequence
  Description of Artificial Sequence: Synthetic destabilizing domain (DD)
MVGSLNCIVAVSQNMGIGKNGDLPWPPLRNEFRYFFRMTTTSSVEGKQNLVIMGKKTWFSIPEKFRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 50 - protein, 187 aa, Artificial Sequence
  Description of Artificial Sequence: Synthetic destabilizing domain (DD)
MVGSLNCIVAVSQNMGIGKNGDLPWPPLRNEFRYFFRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKND

SEQ ID NO: 51 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKADMVWIVGGSSVYKEAMNHPGHLKLFMTRIMQDFESDTFFPEIDLEKYKLLPEYPGVLSDVQEEKGIRYKFEVYEKND

SEQ ID NO: 52 - protein, 187 aa, Artificial Sequence
  Description of Artificial Sequence: Synthetic destabilizing domain (DD)
MVGSLNCIAAVSQNMGIGKNGDLPWPPLRNEFRYFQRMTTTSSVEGKQNLVIMGKKTWFSIPEKNRPLKGRINLVLSRELKEPPQGAHFLSRRLDDALKLTEQPELANKVDMVWIVGGSSVYKEAMNHPGHLKLFVTRIMQDFESDTFFLEIDLEKYKLLPEYPGVLSDVQEEKGIKYKFEVYEKND

SEQ ID NO: 53 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGRLKLFVTRIMQDFGSDTFFPEIDLEKYKLLPEYPGVLSDVQEEKGIKYKFEVYEKND

SEQ ID NO: 54 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMRKKTWFSIPEKNRPLKGRINLVLSRELKEPPQGAHFLSRSLDDALKLTEQPELANKVDMVWLVGGSSVYKEAMNHPGHLKLFVTRIVQDFESDTFFPEIDLEKYKLLPEYPGVLCDVQEEKGIKYKFEVYEKND

SEQ ID NO: 55 - protein, 186 aa, Artificial Sequence
  Description of Artificial Sequence: Synthetic destabilizing domain (DD)
VGSLNCIVAVSQNMGIGKNGDLPWPPLRNDMRYFQRMTTTSSVEGKQNLVIMGKKTWFSIPEKNRPLKGRINLVLSRELKEPPQGAHFLSRSLDDALKLTEQPELANKVDMVWIIGGSSVYKEAMNHPGHLKLFVTRIMQDFESDTFFPEIDLEKYKLLPEYPGVLSDVQEEKGIKYKFEVYEKND

SEQ ID NO: 56 - protein, 186 aa, Artificial Sequence
  Description of Artificial Sequence: Synthetic destabilizing domain (DD)
VGSLNCIVAVSQNMGIGKNGDLPWPPLRNEFRYFFRMTTTSSVEGKQNLVIMGKKTWFSIPEKFRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 57 - protein, 186 aa, Artificial Sequence
  Description of Artificial Sequence: Synthetic destabilizing domain (DD)
VGSLNCIVAVSQNMGIGKNGDLPWPPLRNEFRYFFRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKND

SEQ ID NO: 58 - protein, 550 aa, Artificial Sequence
  Description of Artificial Sequence: Synthetic destabilizing domain (DD)
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 59 - protein, 187 aa, Artificial Sequence
  Description of Artificial Sequence: Synthetic destabilizing domain (DD)
MAGSLNCIVAVSQNMGIGKNGDLPWPPLRNEFGYFRRMTTTSSVEGKQNLVIMGKKTWFSIPEKNRPLKGRINLVLSRELKEPPQGAHFLSRSLDDALKPTEQPELANKVDMVWIVGGSSVYKEAMNHPGHLKLFVTRIMQDFESDTFFPEIDLEKYKLLPEYPGVLSDVQEEKGIKYKFEVYERND

SEQ ID NO: 60 - protein, 187 aa, Artificial Sequence
  Description of Artificial Sequence: Synthetic destabilizing domain (DD)
MVGSLNCIVAVSQNMGIGKNGSLPWPPLRNEMSYFSRMTTTSSVEGKQNLVIMGKKTWFSIPEKSRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 61 - protein, 186 aa, Artificial Sequence
  Description of Artificial Sequence: Synthetic destabilizing domain (DD)
VGSLNCIVAVSQNMGIGKNGSLPWPPLRNEMSYFSRMTTTSSVEGKQNLVIMGKKTWFSIPEKSRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 62 - protein, 187 aa, Artificial Sequence
  Description of Artificial Sequence: Synthetic destabilizing domain (DD)
MVGSLNCIVAVSQNMGNGKNGDLPWPPLRNEFRYFQRMTTTSSVEGKQNLVIMGKKTWFSIPEKNRPLKGRINLVLSRELKEPPQGAHFLSRSLDDASRLTEQPELANKVDTVWIVGGSSVYKEAMNHPGHLKLFVTRIMQDFESDTFFPGIDLEKYKLLPGYPGVLSDVQGEKGIKYKFEVYEKND

SEQ ID NO: 63 - protein, 187 aa, Artificial Sequence
  Description of Artificial Sequence: Synthetic destabilizing domain (DD)
MVGSLNCIVAVSQNMSVGKNGDLPWPPLRNEFRYFQRMTTTSSVEGKQNLVIMGKKTWFSIPEKNRPLKGRINLVLSRELKEPPQGAHLLSRSLDGALKLTEQPELANKVDMVWIVGGSSVYEEAMNHPGHLKLFVTRIVQDFESGTFFPEIDLERYKLLPEYPGVLSDVQEEKGIKYKFEVYEKND

SEQ ID NO: 64 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELREPPQGAHFLSRSLDDALRPTGQPELADKVDMVWIVGGSSVYREAMNRPGHLKLFVTRIMQGFESDTFFPEIDLEKYKLLPEYPGVLSDVQEEKGIKYKLEVYEEND

SEQ ID NO: 65 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTGIMQGSESDTFFPEIDLERYELLPGYPGALSDVQEEKGIECKFEVYEESD

SEQ ID NO: 66 - protein, 187 aa, Artificial Sequence
  Description of Artificial Sequence: Synthetic destabilizing domain (DD)
MVGSLNCIVAVSQSMGIGKNGDLSWPPLRNEFRYLQRMTTTSSVEGKQNLVITGKETWFSIPEKNRPLKGRINLVLSRELKEPPQGAHFLSGGLDDALKLTEQPELANKVDMVWIVGGSSVYKEAMSYPGHLKLLVTRIMQDSESDTFFPEIDLEKYKPPPEYPGVLSDVQEAKGIKYKLEVYEKND

SEQ ID NO: 67 - protein, 187 aa, Artificial Sequence
  Description of Artificial Sequence: Synthetic destabilizing domain (DD)
MVGSLNCIVAVSQNMGIGKNGDLPWPPLRNEFRYLQGMTTTSSVEGKQNLVIMGKKTWFSIPEKARPSEGGINLVLSREPKEPPQGAHFLSRSLDDALGLTEQPELANKVDMVWIVDGSSVYKEAMNHPGHPKLFVTRVIQGFESGTFFPEIDLEKYKLLPEYPGVLSDVQEGKGIKYKFEVYEKNG

SEQ ID NO: 68 - protein, 187 aa, Artificial Sequence
  Description of Artificial Sequence: Synthetic destabilizing domain (DD)
MVGSLNCIVAVSQNMGIGKNGDLPWPPPRHEFRYFQRVTTTSSAEGKQNLVIMGKKTWFSIPEKNRPSKGRIGLVLSGELKEPPQGAHFLSRSLDDTLRLTEQPELTNRVNMVWIVGGSSVYKEAMNHPGHLRPVVTRIMQDFESDAFFPEVDLEKYRLLPEYPGVLSDVQGEKGIKYKFEAYRKND

SEQ ID NO: 69 - protein, 187 aa, Artificial Sequence
  Description of Artificial Sequence: Synthetic destabilizing domain (DD)
MAGSLNCIVAVSQNMGVGKNGDLPWPPLRDGFRYFRRMTTTSSVEGKQNLVIMGKKTWSSIPEKNRPLEGRTNLVLSRELKEPPQGAYLLSRSLDDALKLTEQPELADEAGMVWVVGGSSVDKEAMNHPGHPKLSVTRIVQDFGSDAFFPEIDLEKCKLLPEYPGVLSDAQEERGIKYKFEVYEKSD

SEQ ID NO: 70 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKPTGRSGLADKVDMARIVGGSSVCKEAIRYPGHPKLPVTRTMQDFESDTSLPEVALEKYKLLPEYPGVLSGAQEEKGARYKFEAYERSD

SEQ ID NO: 71 - protein, 186 aa, Artificial Sequence
  Description of Artificial Sequence: Synthetic destabilizing domain (DD)
MVGSLNCIVTVSRSMGIGKDGDLSWPPLRSEFRYFQRTTATSSVEGRQSLVIMGKRTWFSTPERNRPLRGRANLVLSGELKGPPQGAHLLSRSLDGALKLTEQPELADKVDVVRIVGGSSVDEEAMNHPGHLKLFVTRVMRGFESDTLFPGIDLGKRKLLPEYPGVLSDVREEKGIKYKLEVCGNN

SEQ ID NO: 72 - DNA, 561 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttcagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 73 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 74 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattacgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaatcatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 75 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttatttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 76 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaattcatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 77 - DNA, 561 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttcagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggagttcatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 78 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaataacgttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 79 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtgcagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacgcgttttttccagaaattgatttggagaaatataaacttctgccagaatacccaggtgttctctctgatgtccaggaggagaaaggcattaagtacaaatttgaagtatatgagaagaatgat

SEQ ID NO: 80 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacacggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 81 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgctattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 82 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttcaagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 83 - DNA, 561 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttaagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 84 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttcaagagaatgaccacaacctcttcagtagaaggtaaacagaatctggtgattatgggtaagaagacctggttctccattcctgagaagttccgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 85 - DNA, 561 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttttcaggatgaccacaaccagctccgtggagggcaagcagaacctggtcatcatgggcaagaagacatggttctctatccccgagaagttccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 86 - DNA, 558 bp, Artificial Sequence
  Description of Artificial Sequence: Synthetic destabilizing domain (DD)
gtgggcagcctgaactgtatcgtggccgtgtcccagaacatgggcatcggcaagaatggcgatctgccatggccccctctgcggaacgagttcagatacttctttaggatgaccacaaccagctccgtggagggcaagcagaacctggtcatcatgggcaagaagacctggttttctatccccgagaagaacagacctctgaagggcaggatcaatctggtgctgagcagagagctgaaggagccaccacagggagcacacttcctgagccggagcctggacgatgccctgaagctgacagagcagccagagctggccaacaaggtggacatggtgtggatcgtgggcggctctagcgtgatcaaggagtttatgaatcaccccggccacctgaagctgttcgtgaccagaatcatgcaggactttgagtccgatacattctttcctgagatcgatctggagaagtacaagctgctgccagagtatcccggcgtgctgtctgacgtgcaggaggagaagggcatcaagtacaagttcgaggtgtatgagaagaacgat

SEQ ID NO: 87 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattacgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaatcatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 88 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttatttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 89 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaataacgttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 90 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcagggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 91 - DNA, 561 bp, Artificial Sequence
  Description of Artificial Sequence: Synthetic destabilizing domain (DD)
atggttggttcgctaaactgcatcgccgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaaggctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttctagaaattgatttggagaaatataaacttctgccagaatacccaggtgttctctctgatgtccaggaggagaaaggcattaagtacaaatttgaagtatatgagaagaatgat

SEQ ID NO: 92 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggtcctccattcctgagaagaaccgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 93 - DNA, 561 bp, Artificial Sequence
  Description of Artificial Sequence: Synthetic destabilizing domain (DD)
atggttggttcgctaaactgcatcgtcgctgtgtcccagaacatgggcgtcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 94 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaaggatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 95 - DNA, 561 bp, Artificial Sequence
  Description of Artificial Sequence: Synthetic destabilizing domain (DD)
atggttggttcgctaaactgcatcgttgttgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagcttattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 96 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccaggagtctagatgatgccttaaaacttactgaacaaccagaattagtaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 97 - DNA, 561 bp, Artificial Sequence
  Description of Artificial Sequence: Synthetic destabilizing domain (DD)
atggttggttcgctaaaccgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatgcccaggtgttctctctgatgtccaggaggagaaaggcattaagtacaaatttgaagtatatgagaagaatgat

SEQ ID NO: 98 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgtatcacccaggccatcttaaactatttgtgacaaggatcatgcaagactttgaaagtgacacgttttttccagaaattgatttagagaaatataaacttctgccagaatacccaggtgttctctctgatgtccaggaggagaaaggcattaagtacaaatttgaagtatatgagaagaatgat

SEQ ID NO: 99 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgaggagaatgat

SEQ ID NO: 100 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatacttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgagaaggatcatgcaagaccttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 101 - DNA, 561 bp, Artificial Sequence
  Description of Artificial Sequence: Synthetic destabilizing domain (DD)
atggttggttcgctaaactgcgtcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttgaactatttgtgacaaggatcatgcaagactttgaaagtgacacgttttttccagaaattgatttggagaaatataaacttctgccagaatgcccaggtgttctctctgatgtccaggaggagaaaggcattaagtacaaatttgaagtatatgagaagaatgat

SEQ ID NO: 102 - DNA, 561 bp, Artificial Sequence
  Description of Artificial Sequence: Synthetic destabilizing domain (DD)
atggttggttcgctaaactgcatcgtcgctgtgtcccagaacatgggcatcggcgagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcatcttctttccagaagtctagatgatgccttaaaacttactgaacaaccagaattagcaaataaagtagacatggtctggatagttggtggcagttctgtctataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttggagtatatgagaagaatgat

SEQ ID NO: 103 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtaattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaggtatatgagaaggatgat

SEQ ID NO: 104 - DNA, 561 bp, Artificial Sequence
  Description of Artificial Sequence: Synthetic destabilizing domain (DD)
atggttggttcgctgaactgcatcgtcgctgtgtcccagaacatgggcatcggcaagaacggggacctgccctggccaccgctcaggaatgaattcagatatttccagagaatgaccacaacctcctcagtagaaggtaagcagaatctggtgattatgcgtaagaagacctggttctccattcctgagaagaatagacctttaaagggtagaattaatttagttctcagcagagaactcaaggaacctccacaaggagcccattttctttccagaagtctagatgatgccttaaaacttactgaacaaccagaattagcaaataaagtagacatggtctggttagttggtggcagttctgtttataaggaagccatgaatcacccaggccatcttaaactatttgtgacaaggatcgtgcaagactttgaaagtgacacgttttttccagaaattgatttggagaaatataaacttctgccagaatacccaggtgttctctgtgatgtccaggaggagaaaggcattaagtacaaatttgaggtatatgagaagaatgat

SEQ ID NO: 105 - DNA, 561 bp, Artificial Sequence
  Description of Artificial Sequence: Synthetic destabilizing domain (DD)
atggttggctcgctaaactgcatcgtcgctgtgtcccagaacatgggcatcggcaagaacggggactcgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgcttataaggaagccatgaatcacccaggccatcttaaactatttgtgacaaggatcatgcaagactttgaaagtgacacgttttttccagaaattgatttggagaaatgtaaacttctgccagaatacccaggtgttctctctgatgtccaggaggagaaaggcattaagtacaaatttgaagtatatgagaagaatgat

SEQ ID NO: 106 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatacttccagagaatgaccacaacctcttcagtagaaggtaaacagaatctggtgattatgggtaagaagacctggttctccattcctgagaagaatcgacctttaaagggtagaattaatttagtcctcagcagagaactcaaggaacctccacaaggagctcattttctttccagaagtctagatgatgccttaaaacttactgaacaaccagaattagcaaataaagcagacatggtctggatagttggtggcagttctgtttataaggaagccatgaatcacccaggccatcttaaactatttatgacgaggatcatgcaagactttgaaagtgacacgttttttccagaaattgacctggagaaatataaactcctgccagaatacccaggtgttctctctgatgtccaggaggagaaaggcattaggtacaaatttgaagtatatgagaagaatgat

SEQ ID NO: 107 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccaggatacccaggtgttctctctgatgtccaggaggagaaaggctttaagtacaaatttgaagtatatgagaagaatgat

SEQ ID NO: 108 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagcacaaatttggagtatatgagaagaatgat

SEQ ID NO: 109 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacaggatctggtgattatgggtaagaagacctggtcctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactgtttgtgacaaggatcatgcaagactttgaaagtgacacgttttttccagaaattggtttggagaaatataaacttctgccagaatacccaggtgttctctctgatgtccaggaggagaaaggcattaagtacaaatttgaagtatatgagaagaatgat

SEQ ID NO: 110 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatacaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 111 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagaggatgaccacaacctcttcagtagaaggtaaacagaatctggtgattatgggtaagaagacctggttctccattcctgagaagaatcgacctttaaagggtagaattaatttagttcttagcagagaactcaaggaacctccacaaggagctcattttctttccagaagtttagatgatgccttaaaacttactgaacaaccagaattagcaaataaagtagacatggtctggatagttggtggcagttctgtttataaggaagccatgaatcacccaggccgtcttaaactatttgtgacaaggatcatgcaagactttggaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 112 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcggtagaaggtaaacagaatctggtgattatgggtaagaaggcctggttctccattcctgagaagaatcgacctttaaagggtagagctaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 113 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggagcctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagacttcgaaagtgacacgttttttccagaaattgatttggagaaatataaacttctgccagaatacccaggtgttctctctgatgtccaggaggagaaaggcattaagtacaaatttgaagtacatgaggagaatgat

SEQ ID NO: 114 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacgaggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagagttaatttagttcttagcagagaactcaaggaacctccacaaggagctcattttctttccagaagtctagatgatgccttaaaacttactgaacaaccagaattagcaaataaagtagacatggtctggatagttggtggcagttccgtttataaggaagccatgaatcacccaggccatcttaaactatttgtgacaaggatcatgcaagactttgaaagtgacacgttttttccagaaattgatttggagaaatataaacttctgccagaatacccaggcgttctctctgatgtccaggaggagaaaggcactaagtacaaatttgaagtatatgagaagaatgat

SEQ ID NO: 115 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagcccattttctctccagaagtctggatgatgccctaaaacctactggacgatcaggattagcagataaagtagacatggcccggatagttggcggcagctctgtttgtaaggaagccataaggtacccaggccaccctaagctacctgtgacaaggaccatgcaagactttgaaagtgacacgtctcttccagaagttgccttggagaagtataagcttctgccagaatacccaggtgtgctctctggtgcccaggaggagaagggcgctaggtacaagtttgaagcatacgaaaggagtgat

SEQ ID NO: 116 - DNA, 561 bp, Artificial Sequence
  Description of Artificial Sequence: Synthetic destabilizing domain (DD)
atggctggttcgctaaactgcatcgtcgctgtgtcccagaacatgggcatcggcaagaacggggacctgccctggccaccgctcaggaatgaattcggatatttccggagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacctactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaagggcattaagtacaaatttgaagtatatgagaggaatgat

SEQ ID NO: 117 - DNA, 561 bp, Artificial Sequence
  Description of Artificial Sequence: Synthetic destabilizing domain (DD)
atggttggttcgctaaactgcatcgtcgctgtgtcccagaacatgagcgtcggcaagaacggggacctgccctggccaccgctcaggaatgaattcagatattttcagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcatcttctttccagaagtctagatggtgccttaaaacttactgagcaaccagaattagcaaataaagtagacatggtctggatagttggtggcagttctgtttatgaggaagccatgaatcacccaggccatcttaaactatttgtgacaaggatcgtgcaagactttgagagtggcacgtttttcccagaaattgatttggagagatataaacttctgccagaatacccaggtgttctctctgatgtccaggaggagaaaggcattaagtacaaatttgaagtatatgagaagaatgat

SEQ ID NO: 118 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatctccagggaatgaccacaacctcttcagtagaaggtaaacagaatctggtgattatgggtaagaagacctggttctccattcctgagaaggctcgaccttcagagggtggaattaatttagttctcagtagagaacccaaggaacctccacaaggagctcatttcctttccagaagtctagatgatgccttaggacttactgaacaaccggaattagcaaataaagtagacatggtctggatagttgatggcagctctgtttataaggaagccatgaatcacccaggccaccctaaactatttgtgacaagggtcatacaaggctttgaaagtggcacgttttttccagaaattgatttggagaaatataaacttctgccagaatacccaggtgttctctctgacgtccaggaggggaaaggcattaagtacaaatttgaagtatatgagaagaatggt

SEQ ID NO: 119 - DNA, 561 bp, Artificial Sequence
  Description of Artificial Sequence: Synthetic destabilizing domain (DD)
atggttggttcgctaaactgcatcgtcgctgtgtcccagaacatgggcaacggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctggatgatgcctcaagacttactgaacaaccagaattagccaataaagtagacacagtctggatagttggtggcagttctgtttataaggaagccatgaatcacccaggccatcttaaactatttgtgacaaggatcatgcaagactttgaaagtgacacgttttttccaggaattgatttggagaaatataaacttctgccaggatacccaggtgttctctctgatgtccagggggagaaaggcattaagtacaaatttgaagtatatgagaagaatgat

SEQ ID NO: 120 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacagggatcatgcaaggctctgaaagtgacacgttttttccagaaattgatttggagagatatgaacttctgccaggatacccaggtgctctctctgatgttcaggaggagaaaggcattgagtgcaaatttgaagtatatgaggagagtgac

SEQ ID NO: 121 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagagctcagggaacctccacaaggagctcattttctttccagaagtctagatgatgccttaagacctactggacaaccagaattagcagataaagtagacatggtctggatagttggtggcagttctgtttatagggaagccatgaatcgcccaggccatcttaaactgtttgtaacaaggatcatgcaaggctttgaaagtgacacgttttttccagaaattgatttggagaaatataagcttctgccagaatacccaggtgttctctctgatgtccaggaggagaaaggcattaagtacaaacttgaagtgtatgaggagaatgat

SEQ ID NO: 122 - DNA, 561 bp, Artificial Sequence
  Description of Artificial Sequence: Synthetic destabilizing domain (DD)
atggttggttcgctaaactgcatcgtcgctgtgtcccagagcatgggcatcggcaagaacggggacctgtcctggccaccgctcaggaatgaattcagatatctccagagaatgaccacaacctcttcagtagaaggtaaacagaatctggtgattacgggtaaggagacctggttctccattcctgagaagaatcgacctttaaagggtagaatcaatttagtcctcagcagagagctcaaggaacctccacaaggagctcattttctttccgggggtctagatgatgccttaaaacttactgaacaaccagaattagcaaataaagtagacatggtctggatagttggtggcagttctgtttataaggaagccatgagttacccaggccatcttaaactacttgtgacaaggatcatgcaagactctgaaagtgacacgttttttccagaaattgatttggagaaatataaacctccgccagaatacccaggtgttctctctgatgtccaggaggcgaaaggcattaagtacaaacttgaagtatatgagaagaatgat

SEQ ID NO: 123 - DNA, 561 bp, Artificial Sequence
  Description of Artificial Sequence: Synthetic destabilizing domain (DD)
atggctggttcgctaaactgcatcgtcgctgtgtcccagaatatgggcgtcggcaagaacggggacctgccctggccaccgctcagggatggattcagatatttccggagaatgaccacaacctcttcagtagaaggtaaacagaatctggtgattatgggtaagaagacctggtcctccattcctgagaagaatcgacctttagagggtagaactaatttagttctcagcagagaactcaaggaacctccacaaggagcttatcttctttccagaagtctagatgatgccttaaaacttactgagcagccagaattagcagatgaagcaggcatggtctgggtagttggtggcagttctgttgataaggaagccatgaatcacccaggccatcccaaactatctgtgacaaggatcgtgcaagactttggaagtgacgcgttttttccagaaattgatttggagaaatgcaaacttctgccagaatacccaggtgttctctctgatgcccaggaggagagaggcattaagtacaaatttgaagtatacgagaagagtgac

SEQ ID NO: 124 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgcccaggcatgaattcagatatttccagagagtgaccacaacctcttcagcagaaggtaaacagaatctggtgattatgggcaagaagacctggttctccatccctgagaagaatcgaccttcaaagggtagaattggtttagttctcagcggagaactcaaggaacctccacagggagcccactttctctccaggagtctagatgataccttaagacttactgaacaaccagaattaacgaatagagtaaacatggtctggatagttggtggcagttctgtttataaggaggccatgaatcacccaggccaccttagaccagttgtgacaaggatcatgcaggactttgaaagcgacgcgttttttccagaagttgacttggagaaatatagacttctaccagaatacccaggtgttctctctgatgtccagggggagaaaggcattaagtacaaatttgaagcatataggaagaatgat

SEQ ID NO: 125 - DNA, 558 bp, Artificial Sequence
  Description of Artificial Sequence: Synthetic destabilizing domain (DD)
atggttggctcgctaaactgcatcgtcactgtgtcccggagcatgggcatcggcaaggacggggacctgtcctggccaccgctcaggagtgaattcaggtactttcagagaacgaccgcaacctcttcagtagaaggtagacagagtctggtgatcatgggcaagaggacctggttctccactcctgagaggaatcgacccttaaggggtagagctaacttagttctcagcggagagctcaagggacctccacaaggagctcatcttctttccagaagtctagatggtgccttaaaacttactgaacagccagagttagcagataaagtagacgtggtccggatagttggtggcagttctgttgatgaggaagccatgaatcacccaggccatcttaaactatttgtgacaagagtcatgcggggctttgaaagtgatacgctttttccaggaatcgacttggggaaacgtaaacttctgccagaatacccaggtgttctctctgatgtccgggaggagaaaggcattaagtacaaacttgaagtatgtgggaataat

SEQ ID NO: 126 - DNA, 558 bp, Artificial Sequence
  Description of Artificial Sequence: Synthetic destabilizing domain (DD)
gttggttcgctaaactgcatcgtcgctgtgtcccagaacatgggcgtcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 127 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatccaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 128 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgtatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 129 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccgtcttaaactatttgtgacaaggatcatgcaagactttggaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 130 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacgggtccctgccctggccaccgctcaggaatgaaatgagctatttctcgagaatgaccacaacctcttcagtagaaggtaaacagaatctggtgattatgggtaagaagacctggttctccattcctgagaagagtcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 131 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgatatgagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggataattggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 132 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtgcagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacgcgttttttccagaaattgatttggagaaatataaacttctgccagaatacccaggtgttctctctgatgtccaggaggagaaaggcattaagtacaaatttgaagtatatgagaagaatgat

SEQ ID NO: 133 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacacggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 134 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgctattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 135 - DNA, 561 bp, Artificial Sequence
  Description of Artificial Sequence: Synthetic destabilizing domain (DD)
atggtgggcagcctgaactgtatcgtggccgtgtcccagaacatgggcatcggcaagaatggcgatctgccatggccccctctgcggaacgagttcagatacttctttaggatgaccacaaccagctccgtggagggcaagcagaacctggtcatcatgggcaagaagacctggttttctatccccgagaagaacagacctctgaagggcaggatcaatctggtgctgagcagagagctgaaggagccaccacagggagcacacttcctgagccggagcctggacgatgccctgaagctgacagagcagccagagctggccaacaaggtggacatggtgtggatcgtgggcggctctagcgtgatcaaggagtttatgaatcaccccggccacctgaagctgttcgtgaccagaatcatgcaggactttgagtccgatacattctttcctgagatcgatctggagaagtacaagctgctgccagagtatcccggcgtgctgtctgacgtgcaggaggagaagggcatcaagtacaagttcgaggtgtatgagaagaacgat

SEQ ID NO: 136 - DNA, 561 bp, Artificial Sequence
  Description of Artificial Sequence: Synthetic destabilizing domain (DD)
atggttggttcgctaaactgcatcgtcgctgtgtcccagaacatgggcgtcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 137 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatccaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 138 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgtatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 139 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccgtcttaaactatttgtgacaaggatcatgcaagactttggaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 140 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacgggtccctgccctggccaccgctcaggaatgaaatgagctatttctcgagaatgaccacaacctcttcagtagaaggtaaacagaatctggtgattatgggtaagaagacctggttctccattcctgagaagagtcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 141 - DNA, 561 bp, Artificial Sequence
  Description of Artificial Sequence: Synthetic destabilizing domain (DD)
atggttggttcgctaaactgcatcgtcgctgtgtcccagaacatgggcatcggcaagaacggggacctgccctggccaccgctcaggaatgatatgagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggataattggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 142 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 143 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 144 - DNA, 1215 bp, Artificial Sequence
  Description of Artificial Sequence: Synthetic polynucleotide
atgatctctctgattgcggcgctggcagttgaccgcgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 145 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 146 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattacgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaatcatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 147 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttatttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 148 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaattcatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 149 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaataacgttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 150 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtgcagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacgcgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 151 - DNA, 1305 bp, Artificial Sequence
  Description of Artificial Sequence: Synthetic polynucleotide
atggttggttcgctaaactgcatcgtcgctgtgtcccagaacatgggcatcggcaagaacacggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 152 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttcaagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 153 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttcaagagaatgaccacaacctcttcagtagaaggtaaacagaatctggtgattatgggtaagaagacctggttctccattcctgagaagttccgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 154 - DNA, 1305 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgctattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatactagtggtggctctggtggtggtatggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaatga

SEQ ID NO: 155 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattacgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaatcatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 156 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttatttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 157 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaattcatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 158 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaataacgttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 159 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtgcagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacgcgttttttccagaaattgatttggagaaatataaacttctgccagaatacccaggtgttctctctgatgtccaggaggagaaaggcattaagtacaaatttgaagtatatgagaagaatgattga

SEQ ID NO: 160 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacacggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 161 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttcaagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 162 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttcaagagaatgaccacaacctcttcagtagaaggtaaacagaatctggtgattatgggtaagaagacctggttctccattcctgagaagttccgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 163 - DNA, 1302 bp, Artificial Sequence; identical to SEQ ID NO: 161
  Description of Artificial Sequence: Synthetic polynucleotide

SEQ ID NO: 164 - DNA, 1302 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgctattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 165 - DNA, 2034 bp, Artificial Sequence
  Description of Artificial Sequence: Synthetic construct
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggcagcggaggagtgggctccctgaactgcatcgtggccgtgagccagaacatgggcatcggcaagaatggcgacctgccttggccacctctgaggaacgagttcagatactttcagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 166 - DNA, 2034 bp, Artificial Sequence
  Description of Artificial Sequence: Synthetic construct
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggcagcggaggagtgggctccctgaactgcatcgtggccgtgagccagaacatgggcatcggcaagaatggcgacctgccttggccacctctgaggaacgagttcagatactttcagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggagttcatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 167 - DNA, 2034 bp, Artificial Sequence
  Description of Artificial Sequence: Synthetic construct
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggcagcggaggagtgggctccctgaactgcatcgtggccgtgagccagaacatgggcatcggcaagaatggcgacctgccttggccacctctgaggaacgagttcagatactttaagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 168 - DNA, 345 bp, Artificial Sequence
  Description of Artificial Sequence: Synthetic construct
aactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttga

SEQ ID NO: 169 - DNA, 1188 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 170 - DNA, 1752 bp, Artificial Sequence
  Description of Artificial Sequence: Synthetic polynucleotide
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagcggcgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaattcatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 171 - DNA, 1752 bp, Artificial Sequence
  Description of Artificial Sequence: Synthetic polynucleotide
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagcggcgttggttcgctaaactgcatcgtcgctgtgtcccagaacatgggcatcggcaagaacggggacctgccctggccaccgctcaggaatgaattcagatatttcttcagaatgaccacaacctcttcagtagaaggtaaacagaatctggtgattatgggtaagaagacctggttctccattcctgagaagttccgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 172 - DNA, 1623 bp, Artificial Sequence
  Description of Artificial Sequence: Synthetic polynucleotide
atgtgccaccaacagctcgtgatcagctggttctccctggtgttcctggctagccccctggtggccatctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagcggaggaggaggcagcggaggaggaggttctggaggaggcggcagcagaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagctaa

SEQ ID NO: 173 - DNA, 2214 bp, Artificial Sequence
  Description of Artificial Sequence: Synthetic polynucleotide
atgtgccaccagcagctggtcatctcctggttctctctggtgtttctggcatctcctctggtggcagtgggcagcctgaactgtatcgtggccgtgtcccagaacatgggcatcggcaagaatggcgatctgccatggccccctctgcggaacgagttcagatacttctttaggatgaccacaaccagctccgtggagggcaagcagaacctggtcatcatgggcaagaagacctggttttctatccccgagaagaacagacctctgaagggcaggatcaatctggtgctgagcagagagctgaaggagccaccacagggagcacacttcctgagccggagcctggacgatgccctgaagctgacagagcagccagagctggccaacaaggtggacatggtgtggatcgtgggcggctctagcgtgatcaaggagtttatgaatcaccccggccacctgaagctgttcgtgaccagaatcatgcaggactttgagtccgatacattctttcctgagatcgatctggagaagtacaagctgctgccagagtatcccggcgtgctgtctgacgtgcaggaggagaagggcatcaagtacaagttcgaggtgtatgagaagaacgatgagtctcggagagtgaggcgcaataagaggagcaagatctgggagctgaagaaggacgtgtacgtggtggagctggactggtatcctgatgccccaggcgagatggtggtgctgacatgcgacacccccgaggaggatggcatcacatggaccctggatcagtcctctgaggtgctgggctccggcaagacactgaccatccaggtgaaggagttcggcgacgccggccagtacacctgtcacaagggaggagaggtgctgagccactccctgctgctgctgcacaagaaggaggacggcatctggtccaccgacatcctgaaggatcagaaggagcccaagaacaagacattcctgagatgcgaggccaagaattatagcggcaggtttacctgttggtggctgacaaccatctccacagatctgaccttttctgtgaagagctcccggggctctagcgaccctcagggagtgacctgcggagcagccacactgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacctcctctttctttatcagagacatcatcaagccagatcctccaaagaacctgcagctgaagcccctgaagaatagcaggcaggtggaggtgtcctgggagtacccagacacatggagcaccccccacagctatttctccctgacattttgcgtgcaggtgcagggcaagtccaagcgcgagaagaaggaccgggtgttcacagataagacctctgccacagtgatctgtcgcaagaacgcctctatcagcgtgcgcgcccaggatcggtactatagctcctcttggtctgagtgggccagcgtgccttgttccggcggcggcggctctggaggaggaggcagcggcggaggaggctcccggaatctgcctgtggcaacccccgaccctggaatgttcccatgcctgcaccacagccagaacctgctgcgcgccgtgtccaatatgctgcagaaggcccggcagaccctggagttttacccatgtacaagcgaggagatcgaccacgaggatatcaccaaggataagacatccaccgtggaggcatgcctgccactggagctgacaaagaacgagtcttgtctgaacagccgggagacaagcttcatcacaaacggctcttgcctggccagccggaagacctcctttatgatggccctgtgcctgagctccatctacgaggacctgaagatgtatcaggtggagttcaagacaatgaacgccaagctgctgatggaccccaagcgccagatctttctggatcagaatatgctggccgtgatcgacgagctgatgcaggccctgaactttaatagcgagacagtgccccagaagtctagcctggaggagcctgatttctacaagacaaagatcaagctgtgcatcctgctgcacgccttccggatcagagccgtgaccatcgacagagtgatgtcttatctgaatgccagc

SEQ ID NO: 174 - DNA, 2062 bp, Artificial Sequence
  Description of Artificial Sequence: Synthetic construct
atggcactgcctgtgaccgccctgctgctgccactggccctgctgctgcacgcagccaggcccagtggagtgggctccctgaactgcatcgtggccgtgagccagaacatgggcatcggcaagaatggcgacctgccttggccacctctgaggaacgagttcagatactttcagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggagttcatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgatgagtccaggagagtgcggcgcaacaagaggagcaaggacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtgag

SEQ ID NO: 175 - DNA, 2062 bp, Artificial Sequence
  Description of Artificial Sequence: Synthetic construct
atggcactgcctgtgaccgccctgctgctgccactggccctgctgctgcacgcagccaggcccagtggagtgggctccctgaactgcatcgtggccgtgagccagaacatgggcatcggcaagaatggcgacctgccttggccacctctgaggaacgagttcagatactttaagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgatgagtccaggagagtgcggcgcaacaagaggagcaaggacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtgag

SEQ ID NO: 176 - DNA, 2061 bp, Artificial Sequence
  Description of Artificial Sequence: Synthetic construct
atggcactgccagtgaccgccctgctgctgcctctggccctgctgctgcacgcagccagaccaagcggagtgggctccctgaactgcatcgtggccgtgagccagaacatgggcatcggcaagaatggcgacctgccatggccacctctgaggaacgagttcaggtactttcagagaatgaccacaaccagctccgtggagggcaagcagaacctggtcatcatgggcaagaagacctggttcagcatccccgagaagaacaggcctctgaagggcagaatcaatctggtgctgtccagggagctgaaggagccaccacagggagcccactttctgtctcgcagcctggacgatgccctgaagctgacagagcagcccgagctggccaacaaggtggatatggtgtggatcgtgggcggctctagcgtgatcaaggagttcatgaatcaccccggccacctgaagctgttcgtgaccaggatcatgcaggactttgagtccgatacattctttcctgagatcgacctggagaagtataagctgctgccagagtaccccggcgtgctgagcgatgtgcaggaggagaagggcatcaagtataagtttgaggtgtacgagaagaacgacgagtctaggagagtgcggcgcaataagagaagcaaggacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtga

SEQ ID NO: 177 - DNA, 2061 bp, Artificial Sequence
  Description of Artificial Sequence: Synthetic construct
atggcactgcctgtgaccgccctgctgctgccactggccctgctgctgcacgcagccaggccaagcggagtgggctccctgaactgcatcgtggccgtgagccagaacatgggcatcggcaagaatggcgacctgccatggccacctctgaggaacgagttcaggtactttaagagaatgaccacaaccagctccgtggagggcaagcagaacctggtcatcatgggcaagaagacctggttcagcatccccgagaagaacaggcctctgaagggcagaatcaatctggtgctgtccagggagctgaaggagccaccacagggagcccactttctgtctcgcagcctggacgatgccctgaagctgacagagcagcccgagctggccaacaaggtggatatggtgtggatcgtgggcggctctagcgtgatcaaggaggccatgaatcaccccggccacctgaagctgttcgtgaccaggatcatgcaggactttgagtccgatacattctttcctgagatcgacctggagaagtataagctgctgccagagtaccccggcgtgctgagcgatgtgcaggaggagaagggcatcaagtataagttcgaggtgtacgagaagaacgacgagtctaggagagtgcggcgcaataagagaagcaaggacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtga

SEQ ID NO: 178 - DNA, 1824 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatagcggcggtggcagcgacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagctga

SEQ ID NO: 179 - DNA, 1824 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttatttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatagcggcggtggcagcgacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagctga

SEQ ID NO: 180 - DNA, 1824 bp, Artificial Sequence
  Description of Artificial Sequence: Synthetic polynucleotide
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtgcagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacgcgttttttccagaaattgatttggagaaatataaacttctgccagaatacccaggtgttctctctgatgtccaggaggagaaaggcattaagtacaaatttgaagtatatgagaagaatgatagcggcggtggcagcgacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagctga

SEQ ID NO: 181 - DNA, 2217 bp, Artificial Sequence
  Description of Artificial Sequence: Synthetic polynucleotide
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgagtggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaaggatgattaa

SEQ ID NO: 182 - DNA, 2217 bp, Artificial Sequence
  Description of Artificial Sequence: Synthetic polynucleotide
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgagtggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcattcaagactttgaaagtgacacgttttttccagaaattgatttggagaaatataaacttctgccagaatacccaggtgttctctctgatgtccaggaggagaaaggcattaagtacaaatttgaagtatatgagaagaatgattaa

SEQ ID NO: 183 - DNA, 2217 bp, Artificial Sequence
  Description of Artificial Sequence: Synthetic polynucleotide
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgagtggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgtatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaa

SEQ ID NO: 184 - DNA, 2217 bp, Artificial Sequence
  Description of Artificial Sequence: Synthetic polynucleotide
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgagtggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaa

SEQ ID NO: 185 - DNA, 1281 bp, Artificial Sequence
  Description of Artificial Sequence: Synthetic polynucleotide
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagggatccgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 186 - DNA, 1302 bp, Artificial Sequence
  Description of Artificial Sequence: Synthetic construct
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacgggtccctgccctggccaccgctcaggaatgaaatgagctatttctcgagaatgaccacaacctcttcagtagaaggtaaacagaatctggtgattatgggtaagaagacctggttctccattcctgagaagagtcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 187 - DNA, 1302 bp, Artificial Sequence
  Description of Artificial Sequence: Synthetic construct
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgatatgagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggataattggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 188 - DNA, 1302 bp, Artificial Sequence
  Description of Artificial Sequence: Synthetic construct
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcgtcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 189 - DNA, 1302 bp, Artificial Sequence
  Description of Artificial Sequence: Synthetic construct
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatccaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 190 - DNA, 1302 bp, Artificial Sequence
  Description of Artificial Sequence: Synthetic construct
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgtatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 191 - DNA, 1302 bp, Artificial Sequence
  Description of Artificial Sequence: Synthetic construct
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaaggtggctctggtggtggtactagtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccgtcttaaactatttgtgacaaggatcatgcaagactttggaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 192 - protein, 107 aa, Homo sapiens
GVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 193 - protein, 187 aa, Homo sapiens; identical to SEQ ID NO: 1

SEQ ID NO: 194 - protein, 159 aa, Escherichia coli [sequence omitted]

SEQ ID NO: 195 - protein, 327 aa, Homo sapiens
MEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 196 - protein, 189 aa, Homo sapiens
SVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 197 - protein, 260 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 198 - protein, 231 aa, Homo sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 199 - protein, 449 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 223 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 201 - protein, 234 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSNYHLENEVARLKKLSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 202 - protein, 460 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSNYHLENEVARLKKLSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 241 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSNYHLENEVARLKKL

SEQ ID NO: 204 - protein, 471 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSNYHLENEVARLKKLGGSDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 120 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 206 - protein, 111 aa, Artificial Sequence
  Description of Artificial Sequence: Synthetic heavy chain variable domain
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 207 - protein, 464 aa, Artificial Sequence
  Description of Artificial Sequence: Synthetic heavy chain variable domain
MEWSWIFLFLLSGTAGVHSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 208 - protein, 137 aa, Artificial Sequence
  Description of Artificial Sequence: Synthetic heavy chain variable domain
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDPLINKERGGGGSGGGGSGGGGS

SEQ ID NO: 209 - protein, 124 aa, Artificial Sequence
  Description of Artificial Sequence: Synthetic heavy chain variable domain
QVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSS

SEQ ID NO: 210 - protein, 130 aa, Artificial Sequence
  Description of Artificial Sequence: Synthetic heavy chain variable domain
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHIDYGSGSYSPRTSYYYYMSVWGKGTTVTVSS

SEQ ID NO: 211 - protein, 125 aa, Artificial Sequence
  Description of Artificial Sequence: Synthetic heavy chain variable domain
QVQLVQSGGGVVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSS

SEQ ID NO: 212 - protein, 125 aa, Artificial Sequence
  Description of Artificial Sequence: Synthetic heavy chain variable domain
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSS

SEQ ID NO: 213 - protein, 228 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 214 - protein, 98 aa, Artificial Sequence
  Description of Artificial Sequence: Synthetic heavy chain variable domain
  MOD_RES (64)..(65): Any amino acid
  MOD_RES (68)..(69): Any amino acid
  MOD_RES (93)..(93): Any amino acid
  MOD_RES (98)..(98): Any amino acid
QVQLVESGGGLVQPGRSLRLSCAASGFTFDDYAMHWVRQAPGKGLEWVSGISWNSGRIGYADSXXGRXXISRDNAKNSLFLQMNSLRAEDTAXYYCAX

SEQ ID NO: 215 - protein, 125 aa, Artificial Sequence
  Description of Artificial Sequence: Synthetic heavy chain variable domain
  MOD_RES (76)..(76): Any amino acid
QVQLVESGGGLVQPGRSLRLSCAASGFTFDDYAMHWVRQAPGKGLEWVSGISWNSGRIGYADSVKGRFTISRDNAXNSLFLQMNSLRAEDTAVYYCARDQGYHYYDSAEHAFDIWGQGTVVTVSS

SEQ ID NO: 216 - protein, 125 aa, Artificial Sequence
  Description of Artificial Sequence: Synthetic heavy chain variable domain
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSS

SEQ ID NO: 217 - protein, 125 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSS

SEQ ID NO: 218 - protein, 125 aa, Artificial Sequence
  Description of Artificial Sequence: Synthetic heavy chain variable domain
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSS

SEQ ID NO: 219 - protein, 125 aa, Artificial Sequence
  Description of Artificial Sequence: Synthetic heavy chain variable domain
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSS

SEQ ID NO: 220 - protein, 125 aa, Artificial Sequence
  Description of Artificial Sequence: Synthetic heavy chain variable domain
EVQLVESGGGLVQPGRSLRLSCAASGFTFDDYAMHWVRLAPGKGLEWVSGISWNSGRIGYADSVKGRFTISRDNAKNSLFLQMNSLRAKDTAVYYCARDQGYHYYDSAEHAFDIWGQGTMVTVSS

SEQ ID NO: 221 - protein, 125 aa, Artificial Sequence
  Description of Artificial Sequence: Synthetic heavy chain variable domain
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSS

SEQ ID NO: 222 - protein, 464 aa, Artificial Sequence; identical to SEQ ID NO: 207
  Description of Artificial Sequence: Synthetic heavy chain variable domain

SEQ ID NO: 223 - protein, 120 aa, Artificial Sequence; identical to SEQ ID NO: 205
  Description of Artificial Sequence: Synthetic heavy chain variable domain

SEQ ID NO: 224 - protein, 218 aa, Artificial Sequence
  Description of Artificial Sequence: Synthetic heavy chain variable domain
EVQLVESGGGLVQPGGSLRLSCAASGVSLPDYGVSWVRQSPGKGLEWVAVIWGSETTYYADSVKGRFTISADTSKNTYLQMNSLRAEDTAWYCSRHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 225 - protein, 219 aa, Artificial Sequence
  Description of Artificial Sequence: Synthetic heavy chain variable domain
EVQLVESGGGLVQPGGSLRLSCAASGVSLPDYGVSWVRQSPGKGLEWVAVIWGSETTYYADSVKGRFTISADTSKNTYLQMNSLRAEDTAIYYCSRHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 226 - protein, 460 aa, Artificial Sequence; identical to SEQ ID NO: 202
  Description of Artificial Sequence: Synthetic heavy chain variable domain

SEQ ID NO: 227 - protein, 242 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSNYHLENEVARLKKL

SEQ ID NO: 228 - protein, 471 aa, Artificial Sequence; identical to SEQ ID NO: 204
  Description of Artificial Sequence: Synthetic heavy chain variable domain

SEQ ID NO: 229 - protein, 118 aa, Artificial Sequence
  Description of Artificial Sequence: Synthetic heavy chain variable domain
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTV

SEQ ID NO: 230 - protein, 119 aa, Artificial Sequence
  Description of Artificial Sequence: Synthetic heavy chain variable domain
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTV

SEQ ID NO: 231 - protein, 112 aa, Artificial Sequence
  Description of Artificial Sequence: Synthetic light chain variable domain
DIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKR

SEQ ID NO: 232 - protein, 447 aa, Artificial Sequence
  Description of Artificial Sequence: Synthetic light chain variable domain
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 233 - protein, 111 aa, Artificial Sequence
  Description of Artificial Sequence: Synthetic light chain variable domain
QAVLTQPSSVSGAPGQRVTISCTGSSSNIGAGYDVHWYQQLPGTAPKLLIYGNSNRPSGVPDRFSGSKSGTSASLAVTGLQAEDEADYYCQSYDSSLSDVVFGGGTKLTVL

SEQ ID NO: 234 - protein, 107 aa, Artificial Sequence
  Description of Artificial Sequence: Synthetic light chain variable domain
EIVMTQSPSSLPASVGDRVTITCRASQNIKTYLHWYQQKPGKAPNLLIYAASNLQIGVPSRFSGSGSGTDFTLTISSLQPEDFATYFCQQSYITPPTFGQGTRLEIK

SEQ ID NO: 235 - protein, 214 aa, Artificial Sequence
  Description of Artificial Sequence: Synthetic light chain variable domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 236 - protein, 237 aa, Artificial Sequence
  Description of Artificial Sequence: Synthetic light chain variable domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSGGGGSNYHLENEVARLKKLGGGGSDSTYSLSSTLTLSKADYEKHKVYACEVTHQGLSSPVTKSFNRGEC

SEQ ID NO: 237 - protein, 107 aa, Artificial Sequence
  Description of Artificial Sequence: Synthetic light chain variable domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 238 - protein, 107 aa, Artificial Sequence; identical to SEQ ID NO: 237
  Description of Artificial Sequence: Synthetic light chain variable domain

SEQ ID NO: 239 - protein, 115 aa, Artificial Sequence
  Description of Artificial Sequence: Synthetic light chain variable domain
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRAD

SEQ ID NO: 240 - protein, 107 aa, Artificial Sequence; identical to SEQ ID NO: 237
  Description of Artificial Sequence: Synthetic light chain variable domain

SEQ ID NO: 241 - protein, 112 aa, Artificial Sequence
  Description of Artificial Sequence: Synthetic light chain variable domain
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELK

SEQ ID NO: 242 - protein, 106 aa, Artificial Sequence
  Description of Artificial Sequence: Synthetic light chain variable domain
QSALTQPRSVSGFPGQSVTISCTGTTSDDVSWYQQHPGKAPQLMLYDVSKRPSGVPHRFSGSRSGRAASLIISGLQTEDEADYFCCSYAGRYNSVLFGGGTKLTVL

SEQ ID NO: 243 - protein, 106 aa, Artificial Sequence
  Description of Artificial Sequence: Synthetic light chain variable domain
QSALTQPRSVSGFPGQSVTISCTGTTSDDVSWYQQHPGKAPQLMLYDVSKRPSGVPHRFSGSRSGRAASLIISGLQTEDEADYFCSSYAGRYNSVLFGGGTKLTVL

SEQ ID NO: 244 - protein, 110 aa, Artificial Sequence
  Description of Artificial Sequence: Synthetic light chain variable domain
QSALTQPASVSGSPGQSITIFCTGTSSDVGGYNYVSWYQQLPGTAPKLLIYSNNQRPSGVPDRFSGSKSGTSASLAISGLRSEDEADYYCAAWDDSLSVVFGGGTKLTVL

SEQ ID NO: 245 - protein, 109 aa, Artificial Sequence
  Description of Artificial Sequence: Synthetic light chain variable domain
QSVLTQPPSVSAAPGQEVTISCSGSSSNIGNNYVSWYQQLPGTAPKLLIYDNDKRPSGIPDRFSGSKSGTSATLGITGLQTGDEADYYCGTWDGNLSAVFGGGTKVTVL

SEQ ID NO: 246 - protein, 108 aa, Artificial Sequence
  Description of Artificial Sequence: Synthetic light chain variable domain
SYELTQDPAVSVALGQTVRITCQGDSLRSYYASWYQQKPGQAPVLVIYDKNNRPSGIPDRFSGSSSGNTASLTITGAQAEDEADYYCNSRDSSGNNWVFGGGTKLTVL

SEQ ID NO: 247 - protein, 107 aa, Artificial Sequence
  Description of Artificial Sequence: Synthetic light chain variable domain
AIQLTQSPSFLSASVGDRVTITCRASQGISSYLNWYQQRAGKAPELLIYAASNLQSGVPSRFSGSGSGTDFTLTITSVQPEDFATYFCQQGDAFPLTFGPGTKVTIR

SEQ ID NO: 248 - protein, 109 aa, Artificial Sequence
  Description of Artificial Sequence: Synthetic light chain variable domain
EIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLEIK

SEQ ID NO: 249 - protein, 109 aa, Artificial Sequence
  Description of Artificial Sequence: Synthetic light chain variable domain
AIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLDIK

SEQ ID NO: 250 - protein, 111 aa, Artificial Sequence
  Description of Artificial Sequence: Synthetic light chain variable domain
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLNRDWVFGGGTKLTVL

SEQ ID NO: 251 - protein, 109 aa, Artificial Sequence
  Description of Artificial Sequence: Synthetic light chain variable domain
  MOD_RES (5)..(6): Any amino acid
  MOD_RES (8)..(9): Any amino acid
  MOD_RES (93)..(93): Any amino acid
  MOD_RES (104)..(104): Any amino acid
QSVLXXPXXASGSPGQSVTVSCTGTGRDIGAYDYVSWYQQHPGKAPKLLIYGVNKRPSGVPDRFSGSKSDNTASLTVSGLQVEDEADYYCSSXAGRKYVFGTGXKVTVL

SEQ ID NO: 252 - protein, 112 aa, Artificial Sequence
  Description of Artificial Sequence: Synthetic light chain variable domain
  MOD_RES (61)..(61): Any amino acid
QSALTQPASVSGSPGQSITISCTETSSDLGGYNYVSWYQHRPGKAPKLIIYDVTVRPSGVXDRFSGSKSGNTASLTISGLQAEDEADYYCGSYTSSSTLLWVFGGGTKLTVL

SEQ ID NO: 253 - protein, 112 aa, Artificial Sequence
  Description of Artificial Sequence: Synthetic light chain variable domain
QSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 254 - protein, 110 aa, Artificial Sequence
  Description of Artificial Sequence: Synthetic light chain variable domain
QSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLDIK

SEQ ID NO: 255 - protein, 112 aa, Artificial Sequence
  Description of Artificial Sequence: Synthetic light chain variable domain
QSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLDIK

SEQ ID NO: 256 - protein, 111 aa, Artificial Sequence
  Description of Artificial Sequence: Synthetic light chain variable domain
QSVLTQPRSLSGSPGQSVTIACTGASTDVGGYNYVSWYQQHPGKAPKLMIYDVNKRPSGVPDRFSGSKSGNTAFLTISGLQAEDEADYYCCSYAGSYTFEVFGGGTKLTVL

SEQ ID NO: 257 - protein, 111 aa, Artificial Sequence
  Description of Artificial Sequence: Synthetic light chain variable domain
QLVLTQPPSVSGSPGQSVTFSCTGASSDVGGYDHVSWYQHHPGKGPKLLIYDVSKRPSGVPDRFSGSKSGNTASLTISGLQAEDEADYYCCSFAGYYTYWLFGGGTKVTVL

SEQ ID NO: 258 - protein, 106 aa, Artificial Sequence
  Description of Artificial Sequence: Synthetic light chain variable domain
QSALTQPRSVSGFPGQSVTISCTGTTSDDVSWYQQHPGKAPQLMLYDVSKRPSGVPHRFSGSRSGRAASLIISGLQTEDEADYFCCSYAGRYNSVPFGGGTKLTVL

SEQ ID NO: 259 - protein, 99 aa, Artificial Sequence
  Description of Artificial Sequence: Synthetic light chain variable domain
SYVLTQPPSASGTPGQRVTISCSGSSSNIGSNTVNWYQQFPGTAPKLLIYSNNQRPSGVPDRFSGSKSGTSASLAISGLQSEDEAEYYCAAWDDSLNVV

SEQ ID NO: 260 - protein, 110 aa, Artificial Sequence
  Description of Artificial Sequence: Synthetic light chain variable domain
QSVLTQPPSVSAAPGQKVTISCSGSSSNIGNNYVSWYQQLPGTAPKLLIYDNNKRPSGIPDRFSGSKSGTSATLGITGLQTGDEGDYYCGTWDISLRFGVFGGGTKVTVL

SEQ ID NO: 261 - protein, 111 aa, Artificial Sequence
  Description of Artificial Sequence: Synthetic light chain variable domain
QSVLTQPRSVSGSPGQSVTISCTGPISGVGDYTSVSWYQHYPGKTPKLIIYDVTQRPSGVPNRFSGSKSGNTASLTISGLQADDEADYYCCSYEAPTHTYVFGTGTKLTVL

SEQ ID NO: 262 - protein, 124 aa, Artificial Sequence
  Description of Artificial Sequence: Synthetic light chain variable domain
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 263 - protein, 239 aa, Artificial Sequence
  Description of Artificial Sequence: Synthetic light chain variable domain
MRCLAEFLGLLVLWIPGAIGDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 264 - protein, 111 aa, Artificial Sequence
  Description of Artificial Sequence: Synthetic light chain variable domain
QAVLTQPRSVSGSPGQSVTISCTGISSGVDSHRYVSWYQHHPGKAPKLMIYDFSKRPSGVPDRFSGSKSGNTASLTISGLQAEDEADYYCSSYAAISPNYVFGTGTKLTVL

SEQ ID NO: 265 - protein, 110 aa, Artificial Sequence
  Description of Artificial Sequence: Synthetic light chain variable domain
QSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLTVL

SEQ ID NO: 266 - protein, 111 aa, Artificial Sequence
  Description of Artificial Sequence: Synthetic light chain variable domain
QSALTQPASVSGSPGQSITISCTGTSSDVGAYNFVSWYQQLPGTAPKFLIYDNNKRPPGIPDRFSGSKSGTSATLGITGLQTGDEADYYCATWDSGLSAVVFGGGTKLTVL

SEQ ID NO: 267 - protein, 109 aa, Artificial Sequence
  Description of Artificial Sequence: Synthetic light chain variable domain
AIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLEIK

SEQ ID NO: 268 - protein, 108 aa, Artificial Sequence
  Description of Artificial Sequence: Synthetic light chain variable domain
AIRMTQSPSTLSASVGDRVTITCRASQSISHYLAWYQQKPGKAPKLLIFDASRLASGVPSRFSGSGSGTDFTLTISSLQPEDFATYYCQQSYGAPMFTFGPGTRVDLK

SEQ ID NO: 269 - protein, 107 aa, Artificial Sequence
  Description of Artificial Sequence: Synthetic light chain variable domain
DIQLTQSPSTLSASVGDRVTITCRASQSISRWLAWYQQKPGKAPKLLIYDASNLETGVPSRFSGSGSGTDFTFTISSLQPEDIATYYCQQYDNLPLTFGGGTKVEIK

SEQ ID NO: 270 - protein, 109 aa, Artificial Sequence
  Description of Artificial Sequence: Synthetic light chain variable domain
EIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLDIK

SEQ ID NO: 271 - protein, 111 aa, Artificial Sequence
  Description of Artificial Sequence: Synthetic light chain variable domain
QAVLTQPRSVSGSPGQSVTISCTGISSGVDSHRYVSWYQHHPGKAPKLMIYDFSKRPSGVPDRFSGSKSGNTASLTISGLQAEDEADYYCCSYAAISPNYVFGTGTKLTVL

SEQ ID NO: 272 - protein, 121 aa, Artificial Sequence
  Description of Artificial Sequence: Synthetic light chain variable domain
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 273 - protein, 263 aa, Artificial Sequence
  Description of Artificial Sequence: Synthetic single chain variable fragment
WSHPQFEKGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 274 - protein, 247 aa, Artificial Sequence
  Description of Artificial Sequence: Synthetic single chain variable fragment
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGSGSGNWSHPQFEKGSGSGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 275 - protein, 242 aa, Artificial Sequence
  Description of Artificial Sequence: Synthetic single chain variable fragment
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 276 - protein, 247 aa, Artificial Sequence
  Description of Artificial Sequence: Synthetic single chain variable fragment
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 277 - protein, 248 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSSYELTQDPAVSVALGQTVRITCQGDSLRSYYASWYQQKPGQAPVLVIYDKNNRPSGIPDRFSGSSSGNTASLTITGAQAEDEADYYCNSRDSSGNNWVFGGGTKLTVL

SEQ ID NO: 278 - protein, 242 aa, Artificial Sequence
  Description of Artificial Sequence: Synthetic single chain variable fragment
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 279 - protein, 242 aa, Artificial Sequence
  Description of Artificial Sequence: Synthetic single chain variable fragment
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 280 - protein, 242 aa, Artificial Sequence
  Description of Artificial Sequence: Synthetic single chain variable fragment
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 281 - protein, 246 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCCSYAGRYNSVLFGGGTKLTVL

SEQ ID NO: 282 - protein, 252 aa, Artificial Sequence
  Description of Artificial Sequence: Synthetic single chain variable fragment
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHIDYGSGSYSPRTSYYYYMSVWGKGTTVTVSSGGGGSGGGGSGGGGSAIQLTQSPSFLSASVGDRVTITCRASQGISSYLNWYQQRAGKAPELLIYAASNLQSGVPSRFSGSGSGTDFTLTITSVQPEDFATYFCQQGDAFPLTFGPGTKVTIR

SEQ ID NO: 283 - protein, 249 aa, Artificial Sequence
  Description of Artificial Sequence: Synthetic single chain variable fragment
QVQLVQSGGGVVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSEIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLEIK

SEQ ID NO: 284 - protein, 249 aa, Artificial Sequence
  Description of Artificial Sequence: Synthetic single chain variable fragment
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLDIK

SEQ ID NO: 285 - protein, 251 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLNRDWVFGGGTKLTVL

SEQ ID NO: 286 - protein, 252 aa, Artificial Sequence
  Description of Artificial Sequence: Synthetic single chain variable fragment
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 287 - protein, 252 aa, Artificial Sequence; identical to SEQ ID NO: 286
  Description of Artificial Sequence: Synthetic single chain variable fragment

SEQ ID NO: 288 - protein, 252 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 289 - protein, 252 aa, Artificial Sequence; identical to SEQ ID NO: 288
  Description of Artificial Sequence: Synthetic single chain variable fragment

SEQ ID NO: 290 - protein, 252 aa, Artificial Sequence; identical to SEQ ID NO: 288
  Description of Artificial Sequence: Synthetic single chain variable fragment

SEQ ID NO: 291 - protein, 252 aa, Artificial Sequence
  Description of Artificial Sequence: Synthetic single chain variable fragment
  MOD_RES (76)..(76): Any amino acid
  MOD_RES (201)..(201): Any amino acid
QVQLVESGGGLVQPGRSLRLSCAASGFTFDDYAMHWVRQAPGKGLEWVSGISWNSGRIGYADSVKGRFTISRDNAXNSLFLQMNSLRAEDTAVYYCARDQGYHYYDSAEHAFDIWGQGTVVTVSSGGGGSGGGGSGGGGSQSALTQPASVSGSPGQSITISCTETSSDLGGYNYVSWYQHRPGKAPKLIIYDVTVRPSGVXDRFSGSKSGNTASLTISGLQAEDEADYYCGSYTSSSTLLWVFGGGTKLTVL

SEQ ID NO: 292 - protein, 252 aa, Artificial Sequence; identical to SEQ ID NO: 286
  Description of Artificial Sequence: Synthetic single chain variable fragment

SEQ ID NO: 293 - protein, 250 aa, Artificial Sequence
  Description of Artificial Sequence: Synthetic single chain variable fragment
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLDIK

SEQ ID NO: 294 - protein, 252 aa, Artificial Sequence
  Description of Artificial Sequence: Synthetic single chain variable fragment
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLDIK

SEQ ID NO: 295 - protein, 236 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSQSVLTQPRSLSGSPGQSVTIACTGASTDVGGYNYVSWYQQHPGKAPKLMIYDVNKRPSGVPDRFSGSKSGNTAFLTISGLQAEDEADYYCCSYAGSYTFEVFGGGTKLTVL

SEQ ID NO: 296 - protein, 251 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQLVLTQPPSVSGSPGQSVTFSCTGASSDVGGYDHVSWYQHHPGKGPKLLIYDVSKRPSGVPDRFSGSKSGNTASLTISGLQAEDEADYYCCSFAGYYTYWLFGGGTKVTVL

SEQ ID NO: 297 - protein, 246 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCCSYAGRYNSVPFGGGTKLTVL

SEQ ID NO: 298 - protein, 239 aa, Artificial Sequence
  Description of Artificial Sequence: Synthetic single chain variable fragment
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSSYVLTQPPSASGTPGQRVTISCSGSSSNIGSNTVNWYQQFPGTAPKLLIYSNNQRPSGVPDRFSGSKSGTSASLAISGLQSEDEAEYYCAAWDDSLNVV

SEQ ID NO: 299 - protein, 250 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEGDYYCGTWDISLRFGVFGGGTKVTVL

SEQ ID NO: 300 - protein, 251 aa, Artificial Sequence
  Description of Artificial Sequence: Synthetic single chain variable fragment
EVQLVESGGGLVQPGRSLRLSCAASGFTFDDYAMHWVRLAPGKGLEWVSGISWNSGRIGYADSVKGRFTISRDNAKNSLFLQMNSLRAKDTAVYYCARDQGYHYYDSAEHAFDIWGQGTMVTVSSGGGGSGGGGSGGGGSQSVLTQPRSVSGSPGQSVTISCTGPISGVGDYTSVSWYQHYPGKTPKLIIYDVTQRPSGVPNRFSGSKSGNTASLTISGLQADDEADYYCCSYEAPTHTYVFGTGTKLTVL

SEQ ID NO: 301 - protein, 242 aa, Artificial Sequence
  Description of Artificial Sequence: Synthetic single chain variable fragment
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 302 - protein, 242 aa, Artificial Sequence
  Description of Artificial Sequence: Synthetic single chain variable fragment
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 303 - protein, 246 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCSSYAGRYNSVLFGGGTKLTVL

SEQ ID NO: 304 - protein, 249 aa, Artificial Sequence
  Description of Artificial Sequence: Synthetic single chain variable fragment
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSEIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLDIK

SEQ ID NO: 305 - protein, 249 aa, Artificial Sequence
  Description of Artificial Sequence: Synthetic single chain variable fragment
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLEIK

SEQ ID NO: 306 - protein, 252 aa, Artificial Sequence; identical to SEQ ID NO: 288
  Description of Artificial Sequence: Synthetic single chain variable fragment

SEQ ID NO: 307 - protein, 495 aa, Artificial Sequence
  Description of Artificial Sequence: Synthetic single chain variable fragment
METDTLLLWVLLLWVPGSTGEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 308 - protein, 247 aa, Artificial Sequence
  Description of Artificial Sequence: Synthetic single chain variable fragment
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 309 - protein, 251 aa, Artificial Sequence
  Description of Artificial Sequence: Synthetic single chain variable fragment
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQAVLTQPRSVSGSPGQSVTISCTGISSGVDSHRYVSWYQHHPGKAPKLMIYDFSKRPSGVPDRFSGSKSGNTASLTISGLQAEDEADYYCSSYAAISPNYVFGTGTKLTVL

SEQ ID NO: 310 - protein, 250 aa, Artificial Sequence
  Description of Artificial Sequence: Synthetic single chain variable fragment
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLTVL

SEQ ID NO: 311 - protein, 247 aa, Artificial Sequence
  Description of Artificial Sequence: Synthetic single chain variable fragment
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSDIQLTQSPSTLSASVGDRVTITCRASQSISRWLAWYQQKPGKAPKLLIYDASNLETGVPSRFSGSGSGTDFTFTISSLQPEDIATYYCQQYDNLPLTFGGGTKVEIK

SEQ ID NO: 312 - protein, 248 aa, Artificial Sequence
  Description of Artificial Sequence: Synthetic single chain variable fragment
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSTLSASVGDRVTITCRASQSISHYLAWYQQKPGKAPKLLIFDASRLASGVPSRFSGSGSGTDFTLTISSLQPEDFATYYCQQSYGAPMFTFGPGTRVDLK

SEQ ID NO: 313 - protein, 242 aa, Artificial Sequence
  Description of Artificial Sequence: Synthetic single chain variable fragment
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 314 - protein, 251 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQSALTQPASVSGSPGQSITISCTGTSSDVGAYNFVSWYQQLPGTAPKFLIYDNNKRPPGIPDRFSGSKSGTSATLGITGLQTGDEADYYCATWDSGLSAVVFGGGTKLTVL

SEQ ID NO: 315 - protein, 247 aa, Artificial Sequence
  Description of Artificial Sequence: Synthetic single chain variable fragment
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 316 - protein, 250 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQSALTQPASVSGSPGQSITIFCTGTSSDVGGYNYVSWYQQLPGTAPKLLIYSNNQRPSGVPDRFSGSKSGTSASLAISGLRSEDEADYYCAAWDDSLSVVFGGGTKLTVL

SEQ ID NO: 317 - protein, 252 aa, Artificial Sequence
  Description of Artificial Sequence: Synthetic single chain variable fragment
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 318 - protein, 247 aa, Artificial Sequence
  Description of Artificial Sequence: Synthetic single chain variable fragment
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 319 - protein, 247 aa, Artificial Sequence
  Description of Artificial Sequence: Synthetic single chain variable fragment
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 320 - protein, 249 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQEVTISCSGSSSNIGNNYVSWYQQLPGTAPKLLIYDNDKRPSGIPDRFSGSKSGTSATLGITGLQTGDEADYYCGTWDGNLSAVFGGGTKVTVL

SEQ ID NO: 321 - protein, 251 aa, Artificial Sequence
  Description of Artificial Sequence: Synthetic single chain variable fragment
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQAVLTQPRSVSGSPGQSVTISCTGISSGVDSHRYVSWYQHHPGKAPKLMIYDFSKRPSGVPDRFSGSKSGNTASLTISGLQAEDEADYYCCSYAAISPNYVFGTGTKLTVL

SEQ ID NO: 322 - protein, 247 aa, Artificial Sequence
  Description of Artificial Sequence: Synthetic single chain variable fragment
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 323 - protein, 241 aa, Artificial Sequence
  Description of Artificial Sequence: Synthetic single chain variable fragment
QVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKR

SEQ ID NO: 324 - protein, 248 aa, Artificial Sequence; identical to SEQ ID NO: 277
  Description of Artificial Sequence: Synthetic single chain variable fragment

SEQ ID NO: 325 - protein, 246 aa, Artificial Sequence; identical to SEQ ID NO: 281
  Description of Artificial Sequence: Synthetic single chain variable fragment

SEQ ID NO: 326 - protein, 252 aa, Artificial Sequence; identical to SEQ ID NO: 282
  Description of Artificial Sequence: Synthetic single chain variable fragment

SEQ ID NO: 327 - protein, 249 aa, Artificial Sequence; identical to SEQ ID NO: 283
  Description of Artificial Sequence: Synthetic single chain variable fragment

SEQ ID NO: 328 - protein, 249 aa, Artificial Sequence; identical to SEQ ID NO: 284
  Description of Artificial Sequence: Synthetic single chain variable fragment

SEQ ID NO: 329 - protein, 251 aa, Artificial Sequence; identical to SEQ ID NO: 285
  Description of Artificial Sequence: Synthetic single chain variable fragment

SEQ ID NO: 330 - protein, 252 aa, Artificial Sequence; identical to SEQ ID NO: 286
  Description of Artificial Sequence: Synthetic single chain variable fragment

SEQ ID NO: 331 - protein, 252 aa, Artificial Sequence; identical to SEQ ID NO: 286
  Description of Artificial Sequence: Synthetic single chain variable fragment

SEQ ID NO: 332 - protein, 249 aa, Artificial Sequence
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid
QVQLVESGGGLVQPGRSLRLSCAASGFTFDDYAMHWVRQAPGKGLEWVSGISWNSGRIGYADSXXGRXXISRDNAKNSLFLQMNSLRAEDTAXYYCAXDQGXHXYDSAEHAFXIWGQGTVVTVSSGGGGSGGGGSGGGGSQSVLXXPXXASGSPGQSVTVSCTGTGRDIGAYDYVSWYQQHPGKAPKLLIYGVNKRPSGVPDRFSGSKSDNTASLTVSGLQVEDEADYYCSSXAGRKYVFGTGXKVTVL

SEQ ID NO: 333 - protein, 252 aa, Artificial Sequence; identical to SEQ ID NO: 288
  Description of Artificial Sequence: Synthetic single chain variable fragment

SEQ ID NO: 334 - protein, 252 aa, Artificial Sequence; identical to SEQ ID NO: 288
  Description of Artificial Sequence: Synthetic single chain variable fragment

SEQ ID NO: 335 - protein, 252 aa, Artificial Sequence; identical to SEQ ID NO: 288
  Description of Artificial Sequence: Synthetic single chain variable fragment

SEQ ID NO: 336 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 337 - protein, 252 aa, Artificial Sequence; identical to SEQ ID NO: 286
  Description of Artificial Sequence: Synthetic single chain variable fragment

SEQ ID NO: 338 - protein, 250 aa, Artificial Sequence; identical to SEQ ID NO: 293
  Description of Artificial Sequence: Synthetic single chain variable fragment

SEQ ID NO: 339 - protein, 252 aa, Artificial Sequence; identical to SEQ ID NO: 294
  Description of Artificial Sequence: Synthetic single chain variable fragment

SEQ ID NO: 340 - protein, 236 aa, Artificial Sequence; identical to SEQ ID NO: 295
  Description of Artificial Sequence: Synthetic single chain variable fragment

SEQ ID NO: 341 - protein, 251 aa, Artificial Sequence; identical to SEQ ID NO: 296
  Description of Artificial Sequence: Synthetic single chain variable fragment

SEQ ID NO: 342 - protein, 246 aa, Artificial Sequence; identical to SEQ ID NO: 297
  Description of Artificial Sequence: Synthetic single chain variable fragment

SEQ ID NO: 343 - protein, 239 aa, Artificial Sequence; identical to SEQ ID NO: 298
  Description of Artificial Sequence: Synthetic single chain variable fragment

SEQ ID NO: 344 - protein, 250 aa, Artificial Sequence; identical to SEQ ID NO: 299
  Description of Artificial Sequence: Synthetic single chain variable fragment

SEQ ID NO: 345 - protein, 251 aa, Artificial Sequence; identical to SEQ ID NO: 300
  Description of Artificial Sequence: Synthetic single chain variable fragment

SEQ ID NO: 346 - protein, 273 aa, Artificial Sequence
  Description of Artificial Sequence: Synthetic single chain variable fragment
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 347 - protein, 270 aa, Artificial Sequence
  Description of Artificial Sequence: Synthetic single chain variable fragment
MALPVTALLLPLALLLHAARPEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRSDPTSS

SEQ ID NO: 348 - protein, 277 aa, Artificial Sequence
  Description of Artificial Sequence: Synthetic single chain variable fragment
MAPAMESPTLLCVALLFFAPDGVLAEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 349 - protein, 246 aa, Artificial Sequence; identical to SEQ ID NO: 303
  Description of Artificial Sequence: Synthetic single chain variable fragment

SEQ ID NO: 350 - protein, 249 aa, Artificial Sequence; identical to SEQ ID NO: 304
  Description of Artificial Sequence: Synthetic single chain variable fragment

SEQ ID NO: 351 - protein, 249 aa, Artificial Sequence; identical to SEQ ID NO: 305
  Description of Artificial Sequence: Synthetic single chain variable fragment

SEQ ID NO: 352 - protein, 252 aa, Artificial Sequence; identical to SEQ ID NO: 288
  Description of Artificial Sequence: Synthetic single chain variable fragment

SEQ ID NO: 353 - protein, 251 aa, Artificial Sequence; identical to SEQ ID NO: 309
  Description of Artificial Sequence: Synthetic single chain variable fragment

SEQ ID NO: 354 - protein, 250 aa, Artificial Sequence; identical to SEQ ID NO: 310
  Description of Artificial Sequence: Synthetic single chain variable fragment

SEQ ID NO: 355 - protein, 247 aa, Artificial Sequence; identical to SEQ ID NO: 311
  Description of Artificial Sequence: Synthetic single chain variable fragment

SEQ ID NO: 356 - protein, 248 aa, Artificial Sequence; identical to SEQ ID NO: 312
  Description of Artificial Sequence: Synthetic single chain variable fragment

SEQ ID NO: 357 - protein, 251 aa, Artificial Sequence; identical to SEQ ID NO: 314
  Description of Artificial Sequence: Synthetic single chain variable fragment

SEQ ID NO: 358 - protein, 250 aa, Artificial Sequence; identical to SEQ ID NO: 316
  Description of Artificial Sequence: Synthetic single chain variable fragment

SEQ ID NO: 359 - protein, 249 aa, Artificial Sequence; identical to SEQ ID NO: 320
  Description of Artificial Sequence: Synthetic single chain variable fragment

SEQ ID NO: 360 - protein, 251 aa, Artificial Sequence; identical to SEQ ID NO: 321
  Description of Artificial Sequence: Synthetic single chain variable fragment

SEQ ID NO: 361 - protein, 249 aa, Artificial Sequence; identical to SEQ ID NO: 284
  Description of Artificial Sequence: Synthetic single chain variable fragment

SEQ ID NO: 362 - protein, 242 aa, Artificial Sequence; identical to SEQ ID NO: 275
  Description of Artificial Sequence: Synthetic single chain variable fragment

SEQ ID NO: 363 - protein, 245 aa, Artificial Sequence
  Description of Artificial Sequence: Synthetic single chain variable fragment
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 364 - protein, 119 aa, Artificial Sequence
  Description of Artificial Sequence: Synthetic single chain variable fragment
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 365 - protein, 438 aa, Artificial Sequence
  Description of Artificial Sequence: Synthetic single chain variable fragment
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 366 - protein, 272 aa, Artificial Sequence
  Description of Artificial Sequence: Synthetic single chain variable fragment
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSD

SEQ ID NO: 367 - protein, 267 aa, Artificial Sequence
  Description of Artificial Sequence: Synthetic single chain variable fragment
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRSDP

SEQ ID NO: 368 - protein, 270 aa, Artificial Sequence; identical to SEQ ID NO: 347
  Description of Artificial Sequence: Synthetic single chain variable fragment

SEQ ID NO: 369 - protein, 277 aa, Artificial Sequence; identical to SEQ ID NO: 348
  Description of Artificial Sequence: Synthetic single chain variable fragment

SEQ ID NO: 370 - protein, 242 aa, Artificial Sequence; identical to SEQ ID NO: 280
  Description of Artificial Sequence: Synthetic single chain variable fragment

SEQ ID NO: 371 - protein, 242 aa, Artificial Sequence; identical to SEQ ID NO: 301
  Description of Artificial Sequence: Synthetic single chain variable fragment

SEQ ID NO: 372 - protein, 242 aa, Artificial Sequence; identical to SEQ ID NO: 302
  Description of Artificial Sequence: Synthetic single chain variable fragment

SEQ ID NO: 373 - protein, 247 aa, Artificial Sequence; identical to SEQ ID NO: 308
  Description of Artificial Sequence: Synthetic single chain variable fragment

SEQ ID NO: 374 - protein, 247 aa, Artificial Sequence; identical to SEQ ID NO: 315
  Description of Artificial Sequence: Synthetic single chain variable fragment

SEQ ID NO: 375 - protein, 247 aa, Artificial Sequence; identical to SEQ ID NO: 318
  Description of Artificial Sequence: Synthetic single chain variable fragment

SEQ ID NO: 376 - protein, 247 aa, Artificial Sequence; identical to SEQ ID NO: 319
  Description of Artificial Sequence: Synthetic single chain variable fragment

SEQ ID NO: 377 - protein, 247 aa, Artificial Sequence; identical to SEQ ID NO: 322
  Description of Artificial Sequence: Synthetic single chain variable fragment

SEQ ID NO: 378 - protein, 247 aa, Artificial Sequence; identical to SEQ ID NO: 276
  Description of Artificial Sequence: Synthetic single chain variable fragment

SEQ ID NO: 379 - protein, 242 aa, Artificial Sequence; identical to SEQ ID NO: 278
  Description of Artificial Sequence: Synthetic single chain variable fragment

SEQ ID NO: 380 - protein, 495 aa, Artificial Sequence; identical to SEQ ID NO: 307
  Description of Artificial Sequence: Synthetic single chain variable fragment

SEQ ID NO: 381 - protein, 242 aa, Artificial Sequence; identical to SEQ ID NO: 279
  Description of Artificial Sequence: Synthetic single chain variable fragment

SEQ ID NO: 382 - protein, 242 aa, Artificial Sequence; identical to SEQ ID NO: 313
  Description of Artificial Sequence: Synthetic single chain variable fragment

SEQ ID NO: 383 - protein, 252 aa, Artificial Sequence; identical to SEQ ID NO: 317
  Description of Artificial Sequence: Synthetic single chain variable fragment

SEQ ID NO: 384 - protein, 250 aa, Artificial Sequence
  Description of Artificial Sequence: Synthetic single chain variable fragment
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSD

SEQ ID NO: 385 - protein, 242 aa, Artificial Sequence; identical to SEQ ID NO: 313
  Description of Artificial Sequence: Synthetic single chain variable fragment

SEQ ID NO: 386 - protein, 251 aa, Artificial Sequence
  Description of Artificial Sequence: Synthetic single chain variable fragment
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRAD

SEQ ID NO: 387 - protein, 271 aa, Artificial Sequence
  Description of Artificial Sequence: Synthetic single chain variable fragment
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 388 - protein, 248 aa, Artificial Sequence; identical to SEQ ID NO: 277
  Description of Artificial Sequence: Synthetic single chain variable fragment

SEQ ID NO: 389 - protein, 246 aa, Artificial Sequence; identical to SEQ ID NO: 281
  Description of Artificial Sequence: Synthetic single chain variable fragment

SEQ ID NO: 390 - protein, 252 aa, Artificial Sequence; identical to SEQ ID NO: 282
  Description of Artificial Sequence: Synthetic single chain variable fragment

SEQ ID NO: 391 - protein, 249 aa, Artificial Sequence; identical to SEQ ID NO: 283
  Description of Artificial Sequence: Synthetic single chain variable fragment

SEQ ID NO: 392 - protein, 251 aa, Artificial Sequence; identical to SEQ ID NO: 285
  Description of Artificial Sequence: Synthetic single chain variable fragment

SEQ ID NO: 393 - protein, 252 aa, Artificial Sequence; identical to SEQ ID NO: 286
  Description of Artificial Sequence: Synthetic single chain variable fragment

SEQ ID NO: 394 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 395 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 396 - protein, 250 aa, Artificial Sequence; identical to SEQ ID NO: 293
  Description of Artificial Sequence: Synthetic single chain variable fragment

SEQ ID NO: 397 - protein, 252 aa, Artificial Sequence; identical to SEQ ID NO: 294
  Description of Artificial Sequence: Synthetic single chain variable fragment

SEQ ID NO: 398 - protein, 236 aa, Artificial Sequence; identical to SEQ ID NO: 295
  Description of Artificial Sequence: Synthetic single chain variable fragment

SEQ ID NO: 399 - protein, 251 aa, Artificial Sequence; identical to SEQ ID NO: 296
  Description of Artificial Sequence: Synthetic single chain variable fragment

SEQ ID NO: 400 - protein, 246 aa, Artificial Sequence; identical to SEQ ID NO: 297
  Description of Artificial Sequence: Synthetic single chain variable fragment

SEQ ID NO: 401 - protein, 239 aa, Artificial Sequence; identical to SEQ ID NO: 298
  Description of Artificial Sequence: Synthetic single chain variable fragment

SEQ ID NO: 402 - protein, 250 aa, Artificial Sequence; identical to SEQ ID NO: 299
  Description of Artificial Sequence: Synthetic single chain variable fragment

SEQ ID NO: 403 - protein, 251 aa, Artificial Sequence; identical to SEQ ID NO: 300
  Description of Artificial Sequence: Synthetic single chain variable fragment

SEQ ID NO: 404 - protein, 246 aa, Artificial Sequence; identical to SEQ ID NO: 303
  Description of Artificial Sequence: Synthetic single chain variable fragment

SEQ ID NO: 405 - protein, 249 aa, Artificial Sequence; identical to SEQ ID NO: 304
  Description of Artificial Sequence: Synthetic single chain variable fragment

SEQ ID NO: 406 - protein, 249 aa, Artificial Sequence; identical to SEQ ID NO: 305
  Description of Artificial Sequence: Synthetic single chain variable fragment

SEQ ID NO: 407 - protein, 252 aa, Artificial Sequence; identical to SEQ ID NO: 288
  Description of Artificial Sequence: Synthetic single chain variable fragment

SEQ ID NO: 408 - protein, 251 aa, Artificial Sequence; identical to SEQ ID NO: 309
  Description of Artificial Sequence: Synthetic single chain variable fragment

SEQ ID NO: 409 - protein, 250 aa, Artificial Sequence; identical to SEQ ID NO: 310
  Description of Artificial Sequence: Synthetic single chain variable fragment

SEQ ID NO: 410 - protein, 247 aa, Artificial Sequence; identical to SEQ ID NO: 311
  Description of Artificial Sequence: Synthetic single chain variable fragment

SEQ ID NO: 411 - protein, 248 aa, Artificial Sequence; identical to SEQ ID NO: 312
  Description of Artificial Sequence: Synthetic single chain variable fragment

SEQ ID NO: 412 - protein, 251 aa, Artificial Sequence; identical to SEQ ID NO: 314
  Description of Artificial Sequence: Synthetic single chain variable fragment

SEQ ID NO: 413 - protein, 250 aa, Artificial Sequence; identical to SEQ ID NO: 316
  Description of Artificial Sequence: Synthetic single chain variable fragment

SEQ ID NO: 414 - protein, 249 aa, Artificial Sequence; identical to SEQ ID NO: 320
  Description of Artificial Sequence: Synthetic single chain variable fragment

SEQ ID NO: 415 - protein, 251 aa, Artificial Sequence; identical to SEQ ID NO: 321
  Description of Artificial Sequence: Synthetic single chain variable fragment

SEQ ID NO: 416 - protein, 249 aa, Artificial Sequence; identical to SEQ ID NO: 284
  Description of Artificial Sequence: Synthetic single chain variable fragment

SEQ ID NO: 417 - protein, 277 aa, Artificial Sequence
  Description of Artificial Sequence: Synthetic single chain variable fragment
MAPAMESPTLLCVALLFFAPDGVLAEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYVGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYVCMQHLEYPFTFGAGTKLELKRSDP

SEQ ID NO: 418 - protein, 242 aa, Artificial Sequence; identical to SEQ ID NO: 313
  Description of Artificial Sequence: Synthetic CD19 small scFv sequence

SEQ ID NO: 419 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 420 - DNA, 726 bp, Artificial Sequence
  Description of Artificial Sequence: Synthetic CD19 small scFv sequence
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 421 - protein, 120 aa, Homo sapiens
WRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 422 - protein, 49 aa, Homo sapiens
HQRRKYRSNKGESPVEPAEPCRYSCPREEEGSTIPIQEDYRKPEPACSP

SEQ ID NO: 423 - protein, 110 aa, Homo sapiens
RRHQGKQNELSDTAGREINLVDAKLKSEQTEASTRQNSQVLLSETGIYDNDPDLCFRMQEGSEVYSNPCLEENKPGVYASLNHSVIGPNSRLARNVKEAPTEYASICVRS

SEQ ID NO: 424 - protein, 114 aa, Homo sapiens
CCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 425 - protein, 27 aa, Homo sapiens
FWVLVVVGGVLACYSLLVTVAFIIFWV

SEQ ID NO: 426 - protein, 42 aa, Homo sapiens
KRGRKKLLYIFKQPFMRPVQTTQEEDGCSCRFPEEEEGGCEL

SEQ ID NO: 427 - protein, 44 aa, Homo sapiens
FWVRSKRSRLLHSDYMNMTPRRPGPTRKHYQPYAPPRDFAAYRS

SEQ ID NO: 428 - protein, 41 aa, Homo sapiens
RSKRSRGGHSDYMNMTPRRPGPTRKHYQPYAPPRDFAAYRS

SEQ ID NO: 429 - protein, 43 aa, Homo sapiens
RSKRSRGGHSDYIVINMTPRRPGPTRKHYQPYAPPRDFAAYRS

SEQ ID NO: 430 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 431 - protein, 187 aa, Homo sapiens
RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 432 - protein, 187 aa, Homo sapiens; identical to SEQ ID NO: 431

SEQ ID NO: 433 - protein, 54 aa, Homo sapiens
HIWQLRSQCMWPRETQLLLEVPPSTEDARSCQFPEEERGERSAEEKGRLGDLWV

SEQ ID NO: 434 - protein, 60 aa, Homo sapiens
CVKRRKPRGDVVKVIVSVQRKRQEAEGEATVIEALQAPPDVTTVAVEETIPSFTGRSPNH

SEQ ID NO: 435 - protein, 35 aa, Homo sapiens
TKKKYSSSVHDPNGEYMFMRAVNTAKKSRLTDVTL

SEQ ID NO: 436 - protein, 38 aa, Homo sapiens
CWLTKKKYSSSVHDPNGEYMFMRAVNTAKKSRLTDVTL

SEQ ID NO: 437 - protein, 54 aa, Homo sapiens
HLWRRQWRPRRFSALEQGIHPPQAQSKIEELEQEPEPEPEPEPEPEPEPEPEQL

SEQ ID NO: 438 - protein, 42 aa, Homo sapiens
ALYLLRRDQRLPPDAHKPPGGGSFRTPIQEEQADAHSTLAKI

SEQ ID NO: 439 - protein, 37 aa, Homo sapiens
RRDQRLPPDAHKPPGGGSFRTPIQEEQADAHSTLAKI

SEQ ID NO: 440 - protein, 42 aa, Homo sapiens
KRGRKKLLYIFKQPFMRPVQTIQEEDGCSCRFPEEEEGGCEL

SEQ ID NO: 441 - protein, 42 aa, Homo sapiens
KRGRKKLLYIFKQPFMRPVQTTQEEDGCSCRFPEEEEGGYEL

SEQ ID NO: 442 - protein, 225 aa, Homo sapiens
TGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 443 - protein, 154 aa, Homo sapiens
KRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 444 - protein, 194 aa, Homo sapiens
KRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 445 - protein, 47 aa, Homo sapiens
RFSVVKRGRKKLLYIFKQPFMRPVQTTQEEDGCSCRFPEEEEGGCEL

SEQ ID NO: 446 - protein, 341 aa, Homo sapiens
RKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 447 - protein, 48 aa, Homo sapiens
QRRKYRSNKGESPVEPAEPCHYSCPREEEGSTIPIQEDYRKPEPACSP

SEQ ID NO: 448 - protein, 6 aa, Homo sapiens
FAAYRS

SEQ ID NO: 449 - protein, 68 aa, Homo sapiens
FWVLVVVGGVLACYSLLVTVAFIIFWVRSKRSRLLHSDYMNMTPRRPGPTRKHYQPYAPPRDFAAYRS

SEQ ID NO: 450 - protein, 41 aa, Homo sapiens
RSKRSRLLHSDYMNMTPRRPGPTRKHYQPYAPPRDFAAYRS

SEQ ID NO: 451 - protein, 40 aa, Homo sapiens
SKRSRLLHSDYMNMTPRRPGPTRKHYQPYAPPRDFAAYRS

SEQ ID NO: 452 - protein, 106 aa, Homo sapiens
IEVMYPPPYLDNEKSNGTIIHVKGKHLCPSPLFPGPSKPFWVLVVVGGVLACYSLLVTVAFIIFWRSKRSRLLHSDYMNMTPRRPGPTRKHYQPYAPPRDFAAYRS

SEQ ID NO: 453 - protein, 200 aa, Homo sapiens
RSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 454 - protein, 222 aa, Homo sapiens
AAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 455 - protein, 188 aa, Homo sapiens
RSKRSRLLHSDYNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 456 - protein, 70 aa, Homo sapiens
MFWVLVVVGGVLACYSLLVTVAFIIFWVKRGRKKLLYIFKQPFMRPVQTTQEEDGCSCRFPEEEEGGCEL

SEQ ID NO: 457 - protein, 108 aa, Homo sapiens
IEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCEL

SEQ ID NO: 458 - protein, 153 aa, Homo sapiens
RSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 459 - protein, 151 aa, Homo sapiens
KRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 460 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 461 - protein, 127 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 462 - protein, 21 aa, Homo sapiens
DQVYQPLRDRDDAQYSHLGGN

SEQ ID NO: 463 - protein, 171 aa, Homo sapiens; identical to SEQ ID NO: 460

SEQ ID NO: 464 - protein, 127 aa, Homo sapiens; identical to SEQ ID NO: 461

SEQ ID NO: 465 - protein, 21 aa, Homo sapiens
DQVYQPLRDRDDAQYSHLGGN

SEQ ID NO: 466 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 467 - protein, 21 aa, Homo sapiens
NPDYEPIRKGQRDLYSGLNQR

SEQ ID NO: 468 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 469 - protein, 21 aa, Homo sapiens
DQLYQPLKDREDDQYSHLQGN

SEQ ID NO: 470 - protein, 21 aa, Homo sapiens
DQLYQPLKDREDDQYSHLQGN

SEQ ID NO: 471 - protein, 182 aa, Homo sapiens; identical to SEQ ID NO: 468

SEQ ID NO: 472 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 473 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 474 - protein, 164 aa, Homo sapiens; identical to SEQ ID NO: 473

SEQ ID NO: 475 - protein, 21 aa, Homo sapiens
NQLYNELNLGRREEYDVLDKR

SEQ ID NO: 476 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 477 - protein, 21 aa, Homo sapiens
DGLYQGLSTATKDTYDALHMQ

SEQ ID NO: 478 - protein, 112 aa, Homo sapiens
RVKFSRSAEPPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 479 - protein, 113 aa, Homo sapiens
RVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 480 - protein, 114 aa, Homo sapiens
RSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 481 - protein, 98 aa, Homo sapiens
RVKFSRSADAPAYQQGEYDVLDKRRGRDPEMGGKPRRKNPQEGLYNELQKDKMAEAYSEIGMKGERRRGKGHDGLYQGLSTATKDTYDALHMQALPPR

SEQ ID NO: 482 - protein, 112 aa, Homo sapiens
RVKFSRSADAPAYQQGQNQLYNELNLGRREEVDVLDKRRGRDPEMGGKPRRKNPQEGLYNELQKDKMAEAYSEIGMKGERRRGKGHDGLYQGLSTATKDTYDALHMQALPPR

SEQ ID NO: 483 - protein, 173 aa, Homo sapiens
MIPAVVLLLLLLVEQAAALGEPQLCYILDAILFLVGIVLTLLVCRLKIQVRKAAITSYEKSRVKFSRSADAPAYQQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 484 - protein, 113 aa, Homo sapiens
LRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 485 - protein, 60 aa, Homo sapiens
RVKFSRSADAPAYQQGQNQLYNELNLGRREEYDVLDKRRGRDPEMGGKPQRRKNPQEGLY

SEQ ID NO: 486 - protein, 114 aa, Homo sapiens
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 487 - protein, 113 aa, Homo sapiens
RRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 488 - protein, 21 aa, Homo sapiens
NQLYNELNLGRREEYDVLDKR

SEQ ID NO: 489 - protein, 22 aa, Homo sapiens
EGLYNELQKDKMAEAYSEIGMK

SEQ ID NO: 490 - protein, 21 aa, Homo sapiens
DGLYQGLSTATKDTYDALHMQ

SEQ ID NO: 491 - protein, 112 aa, Homo sapiens; identical to SEQ ID NO: 476

SEQ ID NO: 492 - protein, 112 aa, Homo sapiens; identical to SEQ ID NO: 419

SEQ ID NO: 493 - protein, 110 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALP

SEQ ID NO: 494 - protein, 137 aa, Homo sapiens
DPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 495 - protein, 163 aa, Homo sapiens; identical to SEQ ID NO: 472

SEQ ID NO: 496 - protein, 38 aa, Homo sapiens
RSRDQRLPPDAHKPPGGGSFRTPIQEEQADAHSTLAKI

SEQ ID NO: 497 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 498 - protein, 188 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 499 - protein, 226 aa, Homo sapiens; identical to SEQ ID NO: 497

SEQ ID NO: 500 - protein, 21 aa, Homo sapiens
ENLYEGLNLDDCSMYEDISRG

SEQ ID NO: 501 - protein, 84 aa, Homo sapiens
FVPVFLPAKPTTTPAPRPPTPAPTIASQPLSLRPEACRPAAGGAVHTRGLDFACDIYIWAPLAGTCGVLLLSLVITLYCNHRNR

SEQ ID NO: 502 - protein, 84 aa, Homo sapiens
FVPVFLPAKPITTPAPRPPTPAPTIASQPLSLRPEACRPAAGGAVHTRGLDFACDIYIWAPLAGTCGVLLLSLVITLYCNHRNR

SEQ ID NO: 503 - protein, 47 aa, Homo sapiens
PTTTPAPRPPTPAPTIASQPLSLRPEACRPAAGGAVHTRGLDFACDI

SEQ ID NO: 504 - protein, 41 aa, Homo sapiens
AVSLSKMLKKRSPLTTGVFVKMAPTEAECEKQFQPYFIPIN

SEQ ID NO: 505 - protein, 47 aa, Homo sapiens
AVSLSKMLKKRSPLTTGVYMNMTPRRPECEKQFQPYAPPRDFAAYRS

SEQ ID NO: 506 - protein, 20 aa, Homo sapiens
RPRRSPAQDGKVYINMPGRG

SEQ ID NO: 507 - protein, 113 aa, Homo sapiens
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 508 - protein, 112 aa, Homo sapiens
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 509 - protein, 102 aa, Homo sapiens
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 510 - protein, 101 aa, Homo sapiens
MGGLEPCSRLLLLPLLLAVSDCSCSTVSPGVLAGIVMGDLVLTVLIALAVYFLGRLVPRGRGAAEATRKQRITETESPYQELQGQRSDVYSDLNTQRPYYK

SEQ ID NO: 511 - protein, 113 aa, Homo sapiens; identical to SEQ ID NO: 507

SEQ ID NO: 512 - protein, 112 aa, Homo sapiens; identical to SEQ ID NO: 508

SEQ ID NO: 513 - protein, 102 aa, Homo sapiens; identical to SEQ ID NO: 509

SEQ ID NO: 514 - protein, 101 aa, Homo sapiens; identical to SEQ ID NO: 510

SEQ ID NO: 515 - protein, 21 aa, Homo sapiens
ESPYQELQGQRSDVYSDLNTQ

SEQ ID NO: 516 - protein, 21 aa, Homo sapiens
ESPYQELQGQRSDVYSDLNTQ

SEQ ID NO: 517 - protein, 49 aa, Homo sapiens
RSQCMWPRETQLLLEVPPSTEDARSCQFPEEERGERSAEEKGRLGDLWV

SEQ ID NO: 518 - protein, 35 aa, Homo sapiens
TKKKYSSSVHDPNGEFMFMRAVNTAKKSRLTDVTL

SEQ ID NO: 519 - protein, 39 aa, Homo sapiens
KSRQTPPLASVEMEAMEALPVTWGTSSRDEDLENCSHHL

SEQ ID NO: 520 - protein, 149 aa, Homo sapiens
RRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 521 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 522 - protein, 180 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVR

SEQ ID NO: 523 - protein, 240 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDG

SEQ ID NO: 524 - protein, 86 aa, Homo sapiens
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 525 - protein, 21 aa, Homo sapiens
DGVYTGLSTRNQETYETLKHE

SEQ ID NO: 526 - protein, 66 aa, Homo sapiens
DPKLCYILDAILFLYGIVLTLLYCRLKIQVRKAAITSYEKSDGVYTGLSTRNQETYETLKHEKPPQ

SEQ ID NO: 527 - protein, 21 aa, Homo sapiens
DGVYTGLSTRNQETYETLKHE

SEQ ID NO: 528 - protein, 46 aa, Homo sapiens
TTTPAPRPPTPAPTIASQPLSLRPEACRPAAGGAVHTRGLDFACDI

SEQ ID NO: 529 - protein, 31 aa, Homo sapiens
IISFFLALTSTALLFLLFFLTLRFSVVKRGR

SEQ ID NO: 530 - protein, 27 aa, Homo sapiens
IISFFLALTSTALLFLLFFLTLRFSVV

SEQ ID NO: 531 - protein, 26 aa, Homo sapiens
VAAILGLGLVLGLLGPLAILLALYLL

SEQ ID NO: 532 - protein, 363 aa, Homo sapiens
AVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEVVTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 533 - protein, 21 aa, Homo sapiens
AVFGCIFGALVIVTVGGFIFW

SEQ ID NO: 534 - protein, 185 aa, Homo sapiens
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 535 - protein, 106 aa, Homo sapiens
IEVMYPPPYLDNEKSNGTITHVKGKHLCPSPLFPGPSKPFWVLVVVGGVLACYSLLVTVAHIFWVRSKRSRLLHSDYMNMTPRRPGPTRKHYQPYAPPRDFAAYRS

SEQ ID NO: 536 - protein, 27 aa, Homo sapiens
FWVLVVVGGVLACYSLLVTVAFIIFWV

SEQ ID NO: 537 - protein, 66 aa, Homo sapiens
IEVMYPPPYLDNEKSNGTIIHVKGKHLCPSPLFPGPSKPFWVLVVVGGVLACYSLLVTVAFIIFWV

SEQ ID NO: 538 - protein, 33 aa, Homo sapiens
IFWVLVVVGGVLACYSLLVTVAFIIFWVRSKRR

SEQ ID NO: 539 - protein, 68 aa, Homo sapiens; identical to SEQ ID NO: 449

SEQ ID NO: 540 - protein, 28 aa, Homo sapiens
MFWVLVVVGGVLACYSLLVTVAFIIFWV

SEQ ID NO: 541 - protein, 26 aa, Homo sapiens
FWVLVVVGGVLACYSLLVTVAFHFWV

SEQ ID NO: 542 - protein, 28 aa, Homo sapiens
MFWVLVVVGGVLACYSGGVTVAFIIFWV

SEQ ID NO: 543 - protein, 26 aa, Homo sapiens
WVLVVVGGVLACYSLLVTVAFIIFWV

SEQ ID NO: 544 - protein, 69 aa, Homo sapiens
PFWVLVVVGGVLACYSLLVTVAFIIFWVRSKRSRLLHSDYMNMTPRRPGPTRKHYQPYAPPRDFAAYRS

SEQ ID NO: 545 - protein, 180 aa, Homo sapiens
FWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 546 - protein, 216 aa, Homo sapiens
FWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 547 - protein, 140 aa, Homo sapiens
FWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 548 - protein, 222 aa, Homo sapiens; identical to SEQ ID NO: 454

SEQ ID NO: 549 - protein, 23 aa, Homo sapiens
LCYLLDGILFIYGVILTALFLRV

SEQ ID NO: 550 - protein, 51 aa, Homo sapiens
MKWKALFTAAILQAQLPITEAQSFGLLDPKLCYLLDGILFIYGVILTALFL

SEQ ID NO: 551 - protein, 21 aa, Homo sapiens
LCYLLDGILFIYGVILTALFL

SEQ ID NO: 552 - protein, 25 aa, Homo sapiens
ALIVLGGVAGLLLFIGLGIFFCVRC

SEQ ID NO: 553 - protein, 22 aa, Homo sapiens
MALIVLGGVAGLLLFIGLGIFF

SEQ ID NO: 554 - protein, 725 aa, Homo sapiens
ALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIWHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQWKQKLPQKNSSEGNKHHKSTPLLIHCRDGSQQTGIFCALLNLLESAETEEWDIFQWKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 555 - protein, 23 aa, Homo sapiens
PLFIPVAVMVTAFSGLAFIIWLA

SEQ ID NO: 556 - protein, 24 aa, Homo sapiens
ALPAALAVISFLLGLGLGVACVLA

SEQ ID NO: 557 - protein, 21 aa, Homo sapiens
MALPVTALLLPLALLLHAARP

SEQ ID NO: 558 - protein, 286 aa, Homo sapiens
AAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 559 - protein, 226 aa, Homo sapiens
AAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 560 - protein, 83 aa, Homo sapiens
FVPVFLPAKPTTTPAPRPPTPAPTIASQPLSLRPEACRPAAGGAVHTRGLDFACDIYIWAPLAGTCGVLLLSLVITLYCNHRN

SEQ ID NO: 561 - protein, 22 aa, Homo sapiens
IWAPLAGTCGVLLLSLVITLYC

SEQ ID NO: 562 - protein, 24 aa, Homo sapiens
IYIWAPLAGTCGVLLLSLVITLYC

SEQ ID NO: 563 - protein, 25 aa, Homo sapiens
IYIWAPLAGTCGVLLLSLVITLYCR

SEQ ID NO: 564 - protein, 71 aa, Homo sapiens
PTTTPAPRPPTPAPTIASQPLSLRPEACRPAAGGAVHTRGLDFACDIYIWAPLAGTCGVLLLSLVITLYCN

SEQ ID NO: 565 - protein, 25 aa, Homo sapiens
IYIWAPLAGTCGVLLLSLVITLVCR

SEQ ID NO: 566 - protein, 21 aa, Homo sapiens
IYIWAPLAGTCGVLLLSLVIT

SEQ ID NO: 567 - protein, 23 aa, Homo sapiens
IYIWAPLAGTCGVLLLSLVITLY

SEQ ID NO: 568 - protein, 101 aa, Homo sapiens
APVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSD

SEQ ID NO: 569 - protein, 52 aa, Homo sapiens
FFIPLLVVILFAVDTGLFISTQQQVTFLLKIKRTRKGFRLLNPHPKPNPKNN

SEQ ID NO: 570 - protein, 257 aa, Homo sapiens
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 571 - protein, 244 aa, Homo sapiens
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 572 - protein, 86 aa, Homo sapiens; identical to SEQ ID NO: 524

SEQ ID NO: 573 - protein, 54 aa, Homo sapiens
DIFIPLLVVILFAVDTGLFISTQQQVTFLLKIKRTRKGFRLLNPHPKPNPKNNR

SEQ ID NO: 574 - protein, 31 aa, Homo sapiens
PLGWLTVVLLAVAACVLLLTSAQLGLHIWQL

SEQ ID NO: 575 - protein, 24 aa, Homo sapiens
SIISAVVGILLVVVLGVVFGILII

SEQ ID NO: 576 - protein, 113 aa, Homo sapiens
CHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILI

SEQ ID NO: 577 - protein, 21 aa, Homo sapiens
FLVIIVILSALFLGTLACFCV

SEQ ID NO: 578 - protein, 68 aa, Homo sapiens
FWVLVVVGGVLACYSLLVTVAFIIFWVRSKRSRLLHSDYMNMTPRRPGPTRKHYQAYAAARDFAAYRS

SEQ ID NO: 579 - protein, 106 aa, Homo sapiens
IEVMYPPPYLDNEKSNGTIIHVKGKHLCPSPLFPGPSKPFWVLWVGGVLACYSLLVTVAFIIFWVRSKRSRLLHSDYMNMTPRRPGPTRKHYQPYAPPRDFAAYRS

SEQ ID NO: 580 - protein, 28 aa, Homo sapiens
FWVLVVVGGVLACYSLLVTVAFIIFWVR

SEQ ID NO: 581 - protein, 73 aa, Homo sapiens
TPAPRPPTPAPTIASQPLSLRPEACRPAAGGAWTRGLDFACDIYIWAPLAGTCGVLLLSLVITLYCNHRNRRR

SEQ ID NO: 582 - protein, 23 aa, Homo sapiens
LGLLVAGVLVLLVSLGVAIHLCC

SEQ ID NO: 583 - protein, 27 aa, Homo sapiens
ILLAGLVAADAVASLLIVGAVFLCARR

SEQ ID NO: 584 - protein, 21 aa, Homo sapiens
FWLPIGCAAFVVVCILGCILI

SEQ ID NO: 585 - protein, 233 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKD

SEQ ID NO: 586 - protein, 21 aa, Homo sapiens
LLFLILGVLSLLLLVTGAFGF

SEQ ID NO: 587 - protein, 21 aa, Homo sapiens
VAAILGLGLVLGLLGPLAILL

SEQ ID NO: 588 - protein, 20 aa, Homo sapiens
VGWGGLLGSLVLLVWVLAVI

SEQ ID NO: 589 - protein, 27 aa, Homo sapiens
FWALVVVAGVLFCYGLLVTVALCVIWT

SEQ ID NO: 590 - protein, 5 aa, Homo sapiens
DKTHT

SEQ ID NO: 591 - protein, 4 aa, Homo sapiens
CPPC

SEQ ID NO: 592 - protein, 15 aa, Homo sapiens
CPEPKSCDTPPPCPR

SEQ ID NO: 593 - protein, 12 aa, Homo sapiens
ELKTPLGDTTHT

SEQ ID NO: 594 - protein, 10 aa, Homo sapiens
KSCDKTHTCP

SEQ ID NO: 595 - protein, 7 aa, Homo sapiens
KCCVDCP

SEQ ID NO: 596 - protein, 7 aa, Homo sapiens
KYGPPCP

SEQ ID NO: 597 - protein, 16 aa, Homo sapiens
VEPKSPDKTHTCPPCP

SEQ ID NO: 598 - protein, 16 aa, Homo sapiens
LDPKSSDKTHTCPPCP

SEQ ID NO: 599 - protein, 39 aa, Homo sapiens
IEVMYPPPYLDNEKSNGTIIHVKGKHLCPSPLFPGPSKP

SEQ ID NO: 600 - protein, 12 aa, Homo sapiens
GGAVHTRGLDFA

SEQ ID NO: 601 - protein, 45 aa, Homo sapiens
TTTPAPRPPTPAPTIASQPLSLRPEACRPAAGGAVHTRGLDFACD

SEQ ID NO: 602 - protein, 48 aa, Homo sapiens
AKPTTTPAPRPPTPAPTIASQPLSLRPEACRPAAGGAVHTRGLDFACD

SEQ ID NO: 603 - protein, 45 aa, Homo sapiens; identical to SEQ ID NO: 601

SEQ ID NO: 604 - protein, 45 aa, Homo sapiens; identical to SEQ ID NO: 601

SEQ ID NO: 605 - protein, 79 aa, Homo sapiens
TTTPAPRPPTPAPTIASQPLSLRPEACRPAAGGAVHTRGLDFACDEPKSPDKTHTCPPCPAPPVAGPSVFLFPPKPKDT

SEQ ID NO: 606 - protein, 51 aa, Homo sapiens
PAKPTTTPAPRPPTPAPTIASQPLSLRPEACRPAAGGAVHTRGLDFACDIY

SEQ ID NO: 607 - protein, 69 aa, Homo sapiens
TTTPAPRPPTPAPTIASQPLSLRPEACRPAAGGAVHTRGLDFACDIYIWAPLAGTCGVLLLSLVITLYC

SEQ ID NO: 608 - protein, 44 aa, Homo sapiens
TTPAPRPPTPAPTIASQPLSLRPEACRPAAGGAVHTRGLDFACD

SEQ ID NO: 609 - protein, 47 aa, Homo sapiens
TTTPAPRPPTPAPTIASQPLSLRPEACRPAAGGAVHTRGLDFACDIY

SEQ ID NO: 610 - protein, 11 aa, Homo sapiens
LDKTHTCPPCP

SEQ ID NO: 611 - protein, 101 aa, Homo sapiens; identical to SEQ ID NO: 568

SEQ ID NO: 612 - protein, 16 aa, Homo sapiens
GLAVSTISSFFPPGYQ

SEQ ID NO: 613 - protein, 16 aa, Homo sapiens
GLAVSTISSFFPPGYQ

SEQ ID NO: 614 - protein, 282 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 615 - protein, 246 aa, Homo sapiens
YVTVSSQDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 616 - protein, 45 aa, Homo sapiens
KPTTTPAPRPPTPAPTIASQPLSLRPEACRPAAGGAVHTRGLDFA

SEQ ID NO: 617 - protein, 16 aa, Homo sapiens
LEPKSCDKTHTCPPCP

SEQ ID NO: 618 - protein, 43 aa, Homo sapiens
KPTTTPAPRPPTPAPTIASQPLSLRPEACRPAAGGAVHTRGLD

SEQ ID NO: 619 - protein, 15 aa, Homo sapiens
EPKSCDKTHTCPPCP

SEQ ID NO: 620 - protein, 16 aa, Homo sapiens
ELKTPLGDTHTCPRCP

SEQ ID NO: 621 - protein, 15 aa, Homo sapiens
EPKSCDTPPPCPRCP

SEQ ID NO: 622 - protein, 12 aa, Homo sapiens
ESKYGPPCPSCP

SEQ ID NO: 623 - protein, 12 aa, Homo sapiens
ERKCCVECPPCP

SEQ ID NO: 624 - protein, 229 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 625 - protein, 119 aa, Homo sapiens
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 626 - protein, 282 aa, Homo sapiens; identical to SEQ ID NO: 614

SEQ ID NO: 627 - protein, 281 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 628 - protein, 283 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMVVLEDQREVNTSGFAPARPPPQPGSTTFWAWSVLRVPAPPSPQPATYTCVVSHEDSRTLLNASRSLEVSYVTDH

SEQ ID NO: 629 - protein, 58 aa, Homo sapiens
ESPKAQASSVPTAQPQAEGSLAKATTAPATTRNTGRGGEEKKKEKEKEEQEERETKTP

SEQ ID NO: 630 - protein, 282 aa, Homo sapiens; identical to SEQ ID NO: 614

SEQ ID NO: 631 - protein, 282 aa, Homo sapiens; identical to SEQ ID NO: 614

SEQ ID NO: 632 - protein, 282 aa, Homo sapiens; identical to SEQ ID NO: 614

SEQ ID NO: 633 - protein, 282 aa, Homo sapiens; identical to SEQ ID NO: 614

SEQ ID NO: 634 - protein, 234 aa, Homo sapiens
  MOD_RES (91)..(91): Selenocysteine
AEPKSPDKTHTCPPCPAPPVAGPSVFLFPPKPKDTLMIARTPEVTCVVVDVSHEDPEVKFNWYVDGVEVHNAKTKPREEQYNSTYRVVSVXTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKD

SEQ ID NO: 635 - protein, 234 aa, Homo sapiens
AEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKD

SEQ ID NO: 636 - protein, 20 aa, Homo sapiens
AEPKSPDKTHTCPPCPKDPK

SEQ ID NO: 637 - protein, 15 aa, Homo sapiens
EPKSCDKTHTCPPCP

SEQ ID NO: 638 - protein, 233 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEVKCKVSNKALPAPIEKTISKAKGQPREPQVYTLPPSRDELTKNQVSLTCLVKGFYPSDIAVEWESNGQPENNYKTTPPVLDSDGSFFLVSKLTVDKSRWQQGNVFSCSVMHEALHNHYTQKSLSLSPGKKD

SEQ ID NO: 639 - protein, 13 aa, Homo sapiens
SVFLFPPKPKDTL

SEQ ID NO: 640 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - protein, 235 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 642 - protein, 223 aa, Homo sapiens
VECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - protein, 235 aa, Homo sapiens
DPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 644 - protein, 12 aa, Homo sapiens
ERKCCVECPPCP

SEQ ID NO: 645 - protein, 17 aa, Homo sapiens
ELKTPLGDTTHTCPRCP

SEQ ID NO: 646 - protein, 61 aa, Homo sapiens
ELKTPLGDTHTCPRCPEPKSCDTPPPCPRCPEPKSCDTPPPCPRCPEPKSCDTPPPCPRCP

SEQ ID NO: 647 - protein, 230 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 648 - protein, 230 aa, Homo sapiens
ESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 649 - protein, 12 aa, Homo sapiens
SPNMVPHAHHAQ

SEQ ID NO: 650 - protein, 107 aa, Homo sapiens
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 651 - protein, 129 aa, Homo sapiens
ESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 652 - protein, 229 aa, Homo sapiens
ESKYGPPCPSCPAPEFEGGPSVFLFPPKPKDTLMISRTPEVTCVVVDVSQEDPEVQFNWYVDGVEVHQAKTKPREEQFNSTYRVVSVLTVLHQDWLNGKEYKCKVSNKGLPSSIEKTISKAKGQPREPQVYTLPPSQEEMTKNQVSLTCLVKGFVPSDIAVEWESNGQPENNYKTTPPVLDSDGSFFLYSRLTVDKSRWQEGNVFSCSVMHEALHNHYTQKSLSLSLGK

SEQ ID NO: 653 - protein, 229 aa, Homo sapiens
ESKYGPPCPPCPAPEFEGGPSVFLFPPKPKDTLMISRTPEVTCVVVDVSQEDPEVQFNWYVDGVEVHQAKTKPREEQFNSTYRVVSVLTVLHQDWLNGKEYKCKVSNKGLPSSIEKTISKAKGQPREPQVYTLPPSQEEMTKNQVSLTCLVKGFVPSDIAVEWESNGQPENNYKTTPPVLDSDGSFFLYSRLTVDKSRWQEGNVFSCSVMHEALHNHYTQKSLSLSLGK

SEQ ID NO: 654 - protein, 230 aa, Homo sapiens; identical to SEQ ID NO: 647

SEQ ID NO: 655 - DNA, 36 bp, Homo sapiens
gaatctaagtacggaccgccctgccccccttgccct

SEQ ID NO: 656 - protein, 12 aa, Homo sapiens
ESKYGPPCPPCP

SEQ ID NO: 657 - protein, 119 aa, Homo sapiens; identical to SEQ ID NO: 625

SEQ ID NO: 658 - protein, 229 aa, Homo sapiens; identical to SEQ ID NO: 624

SEQ ID NO: 659 - protein, 229 aa, Homo sapiens; identical to SEQ ID NO: 624

SEQ ID NO: 660 - protein, 12 aa, Homo sapiens
ESKYGPPCPPCP

SEQ ID NO: 661 - protein, 9 aa, Homo sapiens
YGPPCPPCP

SEQ ID NO: 662 - protein, 10 aa, Homo sapiens
KYGPPCPPCP

SEQ ID NO: 663 - protein, 13 aa, Homo sapiens
EVVKYGPPCPPCP

SEQ ID NO: 664 - protein, 229 aa, Homo sapiens
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDLSRWQEGNVFSCSVMHEALHNHYTQKSLSLSLGK

SEQ ID NO: 665 - protein, 22 aa, Homo sapiens
ESKYGPPCPPCPGGGSSGGGSG

SEQ ID NO: 666 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 667 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPLEKTISKAKGQPREPQVYTLPPSRDELTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 668 - protein, 231 aa, Homo sapiens; identical to SEQ ID NO: 640

SEQ ID NO: 669 - protein, 486 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 670 - protein, 593 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPETTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 671 - protein, 644 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 672 - protein, 593 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 673 - protein, 644 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 674 - protein, 649 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGISLIAALAVDHVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYKPDDWESVFSEFHDADAQNSHSYCFEILERR

SEQ ID NO: 675 - protein, 598 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 676 - protein, 677 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 677 - protein, 677 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKND

SEQ ID NO: 678 - protein, 677 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGVGSLNCIVAVSQNMGIGKNGDLPWPPLRNEFRYFKRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 679 - protein, 677 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGSGGVGSLNCIVAVSQNMGIGKNGDLPWPPLRNEFRYFFRMTTTSSVEGKQNLVIMGKKTWFSIPEKFRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 680 - protein, 607 aa, Artificial Sequence
  Description of Artificial Sequence: Synthetic construct
MALPVTALLLPLALLLHAARPSGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEESRRVRRNKRSKDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 681 - protein, 658 aa, Artificial Sequence
  Description of Artificial Sequence: Synthetic construct
MALPVTALLLPLALLLHAARPSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRESRRVRRNKRSKDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 682 - protein, 686 aa, Artificial Sequence
  Description of Artificial Sequence: Synthetic construct
MALPVTALLLPLALLLHAARPSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKNDESRRVRRNKRSKDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 683 - protein, 686 aa, Artificial Sequence
  Description of Artificial Sequence: Synthetic construct
MALPVTALLLPLALLLHAARPSGVGSLNCIVAVSQNMGIGKNGDLPWPPLRNEFRYFKRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDESRRVRRNKRSKDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 684 - protein, 677 aa, Artificial Sequence; identical to SEQ ID NO: 676
  Description of Artificial Sequence: Synthetic polypeptide

SEQ ID NO: 685 - protein, 488 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGS

SEQ ID NO: 686 - protein, 508 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGATNFSLLKQAGDVEENPGPGS

SEQ ID NO: 687 - protein, 497 aa, Artificial Sequence
  Description of Artificial Sequence: Synthetic polypeptide
MALPVTALLLPLALLLHAARPYPYDVPDYADIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGS

SEQ ID NO: 688 - protein, 502 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGESRRVRRNKRSKGS

SEQ ID NO: 689 - protein, 486 aa, Artificial Sequence; identical to SEQ ID NO: 669
  Description of Artificial Sequence: Synthetic polypeptide

SEQ ID NO: 690 - protein, 743 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 691 - protein, 885 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 692 - protein, 907 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMLLLVTSLLLCELPHPAFLLIPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 693 - protein, 903 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 694 - protein, 604 aa, Artificial Sequence
  Description of Artificial Sequence: Synthetic construct
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRTRYPYDVPDYAGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 695 - protein, 9 aa, Artificial Sequence
  Description of Artificial Sequence: Synthetic construct
MHRSAAAAT

SEQ ID NO: 696 - protein, 12 aa, Artificial Sequence
  Description of Artificial Sequence: Synthetic construct
IPPPPPLSLPPP

SEQ ID NO: 697 - protein, 43 aa, Artificial Sequence
  Description of Artificial Sequence: Synthetic construct
RYWPKPLGIRPVCVCLYVIFHHIAVFWQCEGPETWPCLLDEHS

SEQ ID NO: 698 - protein, 102 aa, Artificial Sequence
  Description of Artificial Sequence: Synthetic construct
GSFPSRQRNARSVECREGSSSSGSFLKTNNVCSDPLQAAEPPTWRQVPLRPKATCIRYTCKGGTTPVPRCELDSCGKSQMALLKRIQQGAEGCPEGTPLYGI

SEQ ID NO: 699 - protein, 41 aa, Artificial Sequence
  Description of Artificial Sequence: Synthetic construct
SGASVHMLYMCLVEVKKTSRPPEPRGRGFPLKNTMIIWPQP

SEQ ID NO: 700 - protein, 24 aa, Artificial Sequence
  Description of Artificial Sequence: Synthetic construct
ARARRITWPSSRSSCASRCTWRAP

SEQ ID NO: 701 - protein, 23 aa, Artificial Sequence
  Description of Artificial Sequence: Synthetic construct
TATSSRSRARARAAPTRAPRPPS

SEQ ID NO: 702 - protein, 24 aa, Artificial Sequence
  Description of Artificial Sequence: Synthetic construct
PRVAPCPSPGTSCPLSSCTAPRPT

SEQ ID NO: 703 - protein, 9 aa, Artificial Sequence
  Description of Artificial Sequence: Synthetic construct
STPPTSPTT

SEQ ID NO: 704 - protein, 12 aa, Artificial Sequence
  Description of Artificial Sequence: Synthetic construct
SCPSPRASSGSA

SEQ ID NO: 705 - protein, 7 aa, Artificial Sequence
  Description of Artificial Sequence: Synthetic construct
TSRTAAW

SEQ ID NO: 706 - protein, 14 aa, Artificial Sequence
  Description of Artificial Sequence: Synthetic construct
PRTPPCRTASSSTR

SEQ ID NO: 707 - protein, 12 aa, Artificial Sequence
  Description of Artificial Sequence: Synthetic construct
SCAAPTSPPTAP

SEQ ID NO: 708 - protein, 21 aa, Artificial Sequence
  Description of Artificial Sequence: Synthetic construct
CRRRPWAGRPPPSGCTPRTAP

SEQ ID NO: 709 - protein, 7 aa, Artificial Sequence
  Description of Artificial Sequence: Synthetic construct
RARSSRG

SEQ ID NO: 710 - protein, 64 aa, Artificial Sequence
  Description of Artificial Sequence: Synthetic construct
RTAATTTLRSRPPTRPRSPCSCPAPTTSTSSWTSPPTTRTTPSWNSTNAPRAATPPAAWTSCTS

SEQ ID NO: 711 - protein, 107 aa, Homo sapiens; identical to SEQ ID NO: 192

SEQ ID NO: 712 - protein, 187 aa, Homo sapiens; identical to SEQ ID NO: 1

SEQ ID NO: 713 - protein, 159 aa, Escherichia coli [sequence omitted]

SEQ ID NO: 714 - protein, 327 aa, Homo sapiens; identical to SEQ ID NO: 195

SEQ ID NO: 715 - protein, 189 aa, Homo sapiens; identical to SEQ ID NO: 196

SEQ ID NO: 716 - protein, 260 aa, Homo sapiens; identical to SEQ ID NO: 197

SEQ ID NO: 717 - protein, 231 aa, Homo sapiens; identical to SEQ ID NO: 198

SEQ ID NO: 718 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 719 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 720 - protein, 234 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 721 - protein, 231 aa, Homo sapiens
MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 722 - protein, 353 aa, Homo sapiens
MRLAGRQVPEQRSPPPPGLGSARPGSPAVSCGAAAMAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 723 - protein, 61 aa, Homo sapiens
CPPPMSVEHADIWVKSYSLYSRERYICNSGFKRKAGTSSLTECVLNKATNVAHWTTPSLKC

SEQ ID NO: 724 - protein, 237 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 725 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 726 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 727 - protein, 107 aa, Homo sapiens; identical to SEQ ID NO: 192

SEQ ID NO: 728 - protein, 187 aa, Homo sapiens; identical to SEQ ID NO: 1

SEQ ID NO: 729 - protein, 159 aa, Homo sapiens [sequence omitted]

SEQ ID NO: 730 - protein, 327 aa, Homo sapiens; identical to SEQ ID NO: 195

SEQ ID NO: 731 - protein, 189 aa, Homo sapiens; identical to SEQ ID NO: 196

SEQ ID NO: 732 - protein, 260 aa, Homo sapiens; identical to SEQ ID NO: 197

SEQ ID NO: 733 - protein, 231 aa, Homo sapiens; identical to SEQ ID NO: 198

SEQ ID NO: 734 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 735 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 736 - protein, 107 aa, Homo sapiens; identical to SEQ ID NO: 192

SEQ ID NO: 737 - protein, 187 aa, Homo sapiens; identical to SEQ ID NO: 1

SEQ ID NO: 738 - protein, 159 aa, Homo sapiens [sequence omitted]

SEQ ID NO: 739 - protein, 327 aa, Homo sapiens; identical to SEQ ID NO: 195

SEQ ID NO: 740 - protein, 189 aa, Homo sapiens; identical to SEQ ID NO: 196

SEQ ID NO: 741 - protein, 260 aa, Homo sapiens; identical to SEQ ID NO: 197

SEQ ID NO: 742 - protein, 231 aa, Homo sapiens; identical to SEQ ID NO: 198

SEQ ID NO: 743 - protein, 133 aa, Homo sapiens [sequence omitted]

SEQ ID NO: 744 - protein, 415 aa, Homo sapiens
DEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 745 - protein, 431 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 746 - protein, 430 aa, Homo sapiens
PNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 747 - protein, 396 aa, Homo sapiens
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 748 - protein, 395 aa, Homo sapiens
PNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 749 - protein, 119 aa, Artificial Sequence
  Description of Artificial Sequence: Synthetic antibody variable domain
DVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSS

SEQ ID NO: 750 - protein, 118 aa, Artificial Sequence
  Description of Artificial Sequence: Synthetic antibody variable domain
DVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSS

SEQ ID NO: 751 - protein, 118 aa, Artificial Sequence; identical to SEQ ID NO: 750
  Description of Artificial Sequence: Synthetic antibody variable domain

SEQ ID NO: 752 - protein, 120 aa, Artificial Sequence
  Description of Artificial Sequence: Synthetic antibody variable domain
ALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSS

SEQ ID NO: 753 - protein, 119 aa, Artificial Sequence
  Description of Artificial Sequence: Synthetic antibody variable domain
QVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTV

SEQ ID NO: 754 - protein, 119 aa, Artificial Sequence
  Description of Artificial Sequence: Synthetic antibody variable domain
QVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTV

SEQ ID NO: 755 - protein, 117 aa, Artificial Sequence
  Description of Artificial Sequence: Synthetic antibody variable domain
QVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTV

SEQ ID NO: 756 - protein, 119 aa, Artificial Sequence
  Description of Artificial Sequence: Synthetic antibody variable domain
QVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTV

SEQ ID NO: 757 - protein, 112 aa, Artificial Sequence
  Description of Artificial Sequence: Synthetic antibody variable domain
GIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIK

SEQ ID NO: 758 - protein, 111 aa, Artificial Sequence
  Description of Artificial Sequence: Synthetic antibody variable domain
DVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIK

SEQ ID NO: 759 - protein, 112 aa, Artificial Sequence
  Description of Artificial Sequence: Synthetic antibody variable domain
DIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIK

SEQ ID NO: 760 - protein, 107 aa, Artificial Sequence
  Description of Artificial Sequence: Synthetic antibody variable domain
DVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEIN

SEQ ID NO: 761 - protein, 112 aa, Artificial Sequence
  Description of Artificial Sequence: Synthetic antibody variable domain
EIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKR

SEQ ID NO: 762 - protein, 111 aa, Artificial Sequence
  Description of Artificial Sequence: Synthetic antibody variable domain
EIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKR

SEQ ID NO: 763 - protein, 112 aa, Artificial Sequence
  Description of Artificial Sequence: Synthetic antibody variable domain
EIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKR

SEQ ID NO: 764 - protein, 107 aa, Artificial Sequence
  Description of Artificial Sequence: Synthetic antibody variable domain
EIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKR

SEQ ID NO: 765 - protein, 246 aa, Artificial Sequence
  Description of Artificial Sequence: Synthetic small scFv sequence
DVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIK

SEQ ID NO: 766 - protein, 246 aa, Artificial Sequence
  Description of Artificial Sequence: Synthetic small scFv sequence
QVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIK

SEQ ID NO: 767 - protein, 245 aa, Artificial Sequence
  Description of Artificial Sequence: Synthetic small scFv sequence
DVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIK

SEQ ID NO: 768 - protein, 242 aa, Artificial Sequence
  Description of Artificial Sequence: Synthetic small scFv sequence
ALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEIN

SEQ ID NO: 769 - protein, 248 aa, Artificial Sequence
  Description of Artificial Sequence: Synthetic small scFv sequence
QVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKR

SEQ ID NO: 770 - protein, 247 aa, Artificial Sequence
  Description of Artificial Sequence: Synthetic small scFv sequence
QVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKR

SEQ ID NO: 771 - protein, 246 aa, Artificial Sequence
  Description of Artificial Sequence: Synthetic small scFv sequence
QVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKR

SEQ ID NO: 772 - protein, 243 aa, Artificial Sequence
  Description of Artificial Sequence: Synthetic small scFv sequence
QVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKR

SEQ ID NO: 773 - protein, 107 aa, Artificial Sequence
  Description of Artificial Sequence: Synthetic antibody variable domain
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 774 - protein, 108 aa, Artificial Sequence
  Description of Artificial Sequence: Synthetic antibody variable domain
DIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 775 - protein, 124 aa, Artificial Sequence
  Description of Artificial Sequence: Synthetic antibody variable domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSS

SEQ ID NO: 776 - protein, 122 aa, Artificial Sequence
  Description of Artificial Sequence: Synthetic antibody variable domain
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSA

SEQ ID NO: 777 - protein, 122 aa, Artificial Sequence
  Description of Artificial Sequence: Synthetic antibody variable domain
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSA

SEQ ID NO: 778 - protein, 236 aa, Artificial Sequence
  Description of Artificial Sequence: Synthetic scFv sequence
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 779 - protein, 245 aa, Artificial Sequence
  Description of Artificial Sequence: Synthetic scFv sequence
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 780 - protein, 245 aa, Artificial Sequence
  Description of Artificial Sequence: Synthetic scFv sequence
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 781 - protein, 120 aa, Mus musculus
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTV

SEQ ID NO: 782 - protein, 119 aa, Artificial Sequence
  Description of Artificial Sequence: Synthetic antibody variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSS

SEQ ID NO: 783 - protein, 122 aa, Artificial Sequence
  Description of Artificial Sequence: Synthetic antibody variable domain
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSS

SEQ ID NO: 784 - protein, 117 aa, Artificial Sequence
  Description of Artificial Sequence: Synthetic antibody variable domain
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSS

SEQ ID NO: 785 - protein, 107 aa, Mus musculus
DIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 786 - protein, 109 aa, Artificial Sequence
  Description of Artificial Sequence: Synthetic antibody variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIK

SEQ ID NO: 787 - protein, 110 aa, Artificial Sequence
  Description of Artificial Sequence: Synthetic antibody variable domain
EIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIK

SEQ ID NO: 788 - protein, 109 aa, Artificial Sequence
  Description of Artificial Sequence: Synthetic antibody variable domain
EIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIK

SEQ ID NO: 789 - protein, 244 aa, Artificial Sequence
  Description of Artificial Sequence: Synthetic scFv sequence
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 790 - protein, 244 aa, Artificial Sequence
  Description of Artificial Sequence: Synthetic scFv sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKR

SEQ ID NO: 791 - protein, 248 aa, Artificial Sequence
  Description of Artificial Sequence: Synthetic scFv sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKR

SEQ ID NO: 792 - protein, 242 aa, Artificial Sequence
  Description of Artificial Sequence: Synthetic scFv sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKR

SEQ ID NO: 793 - protein, 449 aa, Artificial Sequence
  Description of Artificial Sequence: Synthetic antibody variable domain
QVQLKESGPGLVAPSQSLSITCTVSGFSVTNYGVHWVRQPPGKGLEWLGVIWAGGITNYNSAFMSRLSISKDNSKSQVFLKMNSLQIDDTAMYYCASRGGHYGYALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 794 - protein, 211 aa, Artificial Sequence
  Description of Artificial Sequence: Synthetic antibody variable domain
SIVMTQTPKFLLVSAGDRVTITCKASQSVSNDVTWYQQKAGQSPKLLIYSASNRYSGVPDRFTGSGYGTAFTFTISTVQAEDLAVYFCQQDYSSFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 795 - protein, 446 aa, Artificial Sequence
  Description of Artificial Sequence: Synthetic antibody variable domain
QVQLKESGPGLVAPSQSLSITCTVSGFSVTNYGVHWVRQPPGKGLEWLGVIWAGGITNYNSAFMSRLSISKDNSKSQVFLKMNSLQIDDTAMYYCASRGGHYGYALDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 796 - protein, 448 aa, Artificial Sequence
  Description of Artificial Sequence: Synthetic antibody variable domain
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 797 - protein, 211 aa, Artificial Sequence
  Description of Artificial Sequence: Synthetic antibody variable domain
EIVMTQTPATLSVSAGERVTITCKASGSVSNDVTWYQQKPGQAPRLLIYSASNRYSGVPARFSGSGYGTEFTFTISSVQSEDFAVYFCGGDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 798 - protein, 448 aa, Artificial Sequence
  Description of Artificial Sequence: Synthetic antibody variable domain
QVQLKESGPGVVQPGQSLSISCAVSGFSVTNYGVHWVRQPPGKGLEWLGVIWAGGITNYNSAFMSRLTISKDNSKSTVYLKMNSLQAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 799 - protein, 211 aa, Artificial Sequence
  Description of Artificial Sequence: Synthetic antibody variable domain
SIVMTQTPKTLSVSAGERVTITCKASQSVSNDVTWYQQKPGQSPKLLIYSASNRYSGVPDRFSGSGYGTAFTFTISSVQAEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 800 - protein, 446 aa, Artificial Sequence
  Description of Artificial Sequence: Synthetic antibody variable domain
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 801 - protein, 105 aa, Homo sapiens
EVQLVESGGGLVQPGGSLRLSCAASGFTVSGSYMSWVRQAPGKGLEWVSVIYSGGSTYYADSVKGRFTISRDNSKNTLYLQMNSLRAEDTAVYYCARDLRGSYDY

SEQ ID NO: 802 - protein, 102 aa, Homo sapiens
EIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRT

SEQ ID NO: 803 - protein, 449 aa, Artificial Sequence; identical to SEQ ID NO: 793
  Description of Artificial Sequence: Synthetic antibody variable domain

SEQ ID NO: 804 - protein, 211 aa, Artificial Sequence; identical to SEQ ID NO: 794
  Description of Artificial Sequence: Synthetic antibody variable domain

SEQ ID NO: 805 - protein, 449 aa, Artificial Sequence
  Description of Artificial Sequence: Synthetic antibody variable domain
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 806 - protein, 211 aa, Artificial Sequence
  Description of Artificial Sequence: Synthetic antibody variable domain
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 807 - protein, 446 aa, Artificial Sequence; identical to SEQ ID NO: 795
  Description of Artificial Sequence: Synthetic antibody variable domain

SEQ ID NO: 808 - protein, 446 aa, Artificial Sequence; identical to SEQ ID NO: 800
  Description of Artificial Sequence: Synthetic antibody variable domain

SEQ ID NO: 809 - protein, 119 aa, Artificial Sequence
  Description of Artificial Sequence: Synthetic antibody variable domain
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 810 - protein, 104 aa, Artificial Sequence
  Description of Artificial Sequence: Synthetic antibody variable domain
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 811 - protein, 118 aa, Artificial Sequence
  Description of Artificial Sequence: Synthetic antibody variable domain
QVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSA

SEQ ID NO: 812 - protein, 118 aa, Artificial Sequence
  Description of Artificial Sequence: Synthetic antibody variable domain
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSS

SEQ ID NO: 813 - protein, 108 aa, Artificial Sequence
  Description of Artificial Sequence: Synthetic antibody variable domain
ENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVK

SEQ ID NO: 814 - protein, 108 aa, Artificial Sequence
  Description of Artificial Sequence: Synthetic antibody variable domain
ENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIK

SEQ ID NO: 815 - protein, 113 aa, Artificial Sequence
  Description of Artificial Sequence: Synthetic antibody variable domain
DVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 816 - protein, 113 aa, Artificial Sequence
  Description of Artificial Sequence: Synthetic antibody variable domain
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSS

SEQ ID NO: 817 - protein, 118 aa, Artificial Sequence; identical to SEQ ID NO: 811
  Description of Artificial Sequence: Synthetic antibody variable domain

SEQ ID NO: 818 - protein, 118 aa, Artificial Sequence; identical to SEQ ID NO: 812
  Description of Artificial Sequence: Synthetic antibody variable domain

SEQ ID NO: 819 - protein, 108 aa, Artificial Sequence; identical to SEQ ID NO: 813
  Description of Artificial Sequence: Synthetic antibody variable domain

SEQ ID NO: 820 - protein, 108 aa, Artificial Sequence; identical to SEQ ID NO: 814
  Description of Artificial Sequence: Synthetic antibody variable domain

SEQ ID NO: 821 - protein, 240 aa, Artificial Sequence
  Description of Artificial Sequence: Synthetic antibody variable domain
MEAPAQLLFLLLLWLPDTTGEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 822 - protein, 462 aa, Artificial Sequence
  Description of Artificial Sequence: Synthetic antibody variable domain
MGWTWIFILILSVTTGVHSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 823 - protein, 120 aa, Artificial Sequence
  Description of Artificial Sequence: Synthetic antibody variable domain
QVQLVESGAEVKKPGASVKVSCKASGYTFTSYAIHWVRQAPGQRLEWMGWINAGNGYRKYSQKFQGRVTVTRDTSASTAYMELSSLRSEDTAVYYCARFEGGMVTAMDFWGQGTLVTVSS

SEQ ID NO: 824 - protein, 112 aa, Artificial Sequence
  Description of Artificial Sequence: Synthetic antibody variable domain
DVVMTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPFTFGPGTKVDIK

SEQ ID NO: 825 - protein, 120 aa, Artificial Sequence
  Description of Artificial Sequence: Synthetic antibody variable domain
EVQLLESGAEVKKPGASVKVSCKASGYTFTSYAIHWVRQAPGQRLEWMGWINAGNGYRKYSQKFQGRVTVTRDTSASTAYMELSSLRSEDTAVYYCARFEGGMVTAMDYWGQGTLVTVSS

SEQ ID NO: 826 - protein, 112 aa, Artificial Sequence
  Description of Artificial Sequence: Synthetic antibody variable domain
DIQVTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGIKVDIK

SEQ ID NO: 827 - protein, 119 aa, Artificial Sequence
  Description of Artificial Sequence: Synthetic antibody variable domain
QVQLVESGAEVKKPGASVKMSCRASGYTFTRYYMHWVRQAPGQGLEWMGIINPSAGSTSYAQKFQDRVTMTRDTSRSTVYMELSSLRSEDTAVYYCARRVVVGGPFDFWGQGTLVTVSS

SEQ ID NO: 828 - protein, 113 aa, Artificial Sequence
  Description of Artificial Sequence: Synthetic antibody variable domain
DIQMTQSPDSLAVSLGERATINCKSSQSVLYSPNKKNYLAWYQQKPGQPPSLLFYWASTRESGVPDRFSGSGSGTDFTLTISSLQAEDVAVYYCQQYYSTPPTFGQGTKVEIK

SEQ ID NO: 829 - protein, 119 aa, Artificial Sequence
  Description of Artificial Sequence: Synthetic antibody variable domain
QVQLVESGAEVKKPGASVRVSCKASGYRFISYYMHWVRQAPGQGLEWMGIINPSGGSTSYAQKFQGRVTMTRDTSTSTIYMELSSLRSEDTAVYYCARRNIVTGPFDYWGQGTLVTVSS

SEQ ID NO: 830 - protein, 113 aa, Artificial Sequence
  Description of Artificial Sequence: Synthetic antibody variable domain
DVVMTQTPDSLAVSLGERATINCKSSQSVLYISNNKNYLAWYQQKPGQPPKLLIYWASTRESGVPDRFSGSGSGTDFTLTISSLQAEDVAVYYCQHYYSTPPTFGQGTKLEIK

SEQ ID NO: 831 - protein, 119 aa, Artificial Sequence
  Description of Artificial Sequence: Synthetic antibody variable domain
QVQLVESGAEVKKPGASVKVSCKASGYTFARYYMHWVRQAPGQGPEWMGIINPSGGSTSYAQKFQGRVTVTRDTSTSTVYMELSSLRSEDTAVYYCARRVVLGGPFDYWGQGTLVTVSS

SEQ ID NO: 832 - protein, 113 aa, Artificial Sequence
  Description of Artificial Sequence: Synthetic antibody variable domain
DIRVTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 833 - protein, 119 aa, Artificial Sequence
  Description of Artificial Sequence: Synthetic antibody variable domain
EVQLLESGAEVKKPGASVKVSCKASGYTFTRYYMHWVRQAPGQGLEWMGIINPSSGSTSYAQKFQGRVTMTRDTSTSTVYMELSSLRSEDMAVYYCARRVVVGGPFDYWGQGTLVTVSS

SEQ ID NO: 834 - protein, 113 aa, Artificial Sequence
  Description of Artificial Sequence: Synthetic antibody variable domain
DIQLTQSPDSLAVSLGERATINCKSSQSILYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 835 - protein, 120 aa, Artificial Sequence
  Description of Artificial Sequence: Synthetic antibody variable domain
EVQLLESGAEVKKPGASVKVSCKASGYIFSRYAIHWVRQAPGQGLEWMGWINPFNGFTKYSQKFQGRVALTRDRSATTGYMELSSLTSEDTAVYYCARLESNKFYAFDIWGQGTMVTVSS

SEQ ID NO: 836 - protein, 112 aa, Artificial Sequence
  Description of Artificial Sequence: Synthetic antibody variable domain
EIVMTQSPLSLPVTPGEPASISCTSSQSLLHSNGYNYLDWYLQKPGQSPQLLIYLGSNRASGVPDRFSGSGSGTDFTLKISTVEAEDVGVYYCMQALQTPWTFGQGTKVEIK

SEQ ID NO: 837 - protein, 120 aa, Artificial Sequence
  Description of Artificial Sequence: Synthetic antibody variable domain
QVQLLESGAEVKKPGASVKVSCKASGYTFTSYAMHWVRQAPGQRLEWMGWINAGNGNTIYSQKFQARVTITRDTSASTAYMELSSLRSEDTAVYYCARWVGGVASYFDYWGQGTLVTVSS

SEQ ID NO: 838 - protein, 112 aa, Artificial Sequence
  Description of Artificial Sequence: Synthetic antibody variable domain
EIVLTQSPLSLSVTPGEPASISCRSSQSLLHRNGYNYFDWYLQQPGQSPQLLIYLGSNRASGVPDRFSGSGSGTDFTLKISRVEAEDVGVYYCMQALQTPYTFGQGTKLEIK

SEQ ID NO: 839 - protein, 121 aa, Artificial Sequence
  Description of Artificial Sequence: Synthetic antibody variable domain
QVQLLESGAEVKKPGASVKVSCEASGYTFTSSDINWVRQATGQGLEWMGWMNPNSGNTGYAQKFQGRVTMTRNTSISTAYMELSSLRSEDTAVYYCARERPRRRGGGFDIWGQGTMVTVSS

SEQ ID NO: 840 - protein, 121 aa, Artificial Sequence
  Description of Artificial Sequence: Synthetic antibody variable domain
QVQLQQSGAEVKKPGASVKVSCEASGYTFTSSDINWVRQATGQGLEWMGWMNPKSGNTGYAQKFQGRVTMTRNTSISTAYMELSSLRSEDTAVYYCARERPRRRGGGFDIWGQGTMVTVSS

SEQ ID NO: 841 - protein, 108 aa, Artificial Sequence
  Description of Artificial Sequence: Synthetic antibody variable domain
DIRMTQSPSSLSASVGDRVTITCRASQGISNYLAWYQQKPGKVPKFLIYAASTLQSGVPSRFSGSGSGTDFTLTISSLQPEDVATYYCQKYNSAPWTFGQGTKVEIKN

SEQ ID NO: 842 - protein, 119 aa, Artificial Sequence
  Description of Artificial Sequence: Synthetic antibody variable domain
QVQLVESGAEVKKPGASVKVSCKASGYTFTNYYMHWVRQAPGQGLEWMGIINPSRGSTSYAQKFQGRVTMTRDTSTSTVYMELSSLRSEDTAVYYCARRQMATGPFDYWGQGTLVTVSS

SEQ ID NO: 843 - protein, 113 aa, Artificial Sequence
  Description of Artificial Sequence: Synthetic antibody variable domain
DIVLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKLEIK

SEQ ID NO: 844 - protein, 240 aa, Artificial Sequence; identical to SEQ ID NO: 821
  Description of Artificial Sequence: Synthetic antibody variable domain

SEQ ID NO: 845 - protein, 462 aa, Artificial Sequence; identical to SEQ ID NO: 822
  Description of Artificial Sequence: Synthetic antibody variable domain

SEQ ID NO: 846 - protein, 239 aa, Artificial Sequence
  Description of Artificial Sequence: Synthetic antibody variable domain
MKLPVRLLVLMFWIPASLSDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 847 - protein, 595 aa, Artificial Sequence
  Description of Artificial Sequence: Synthetic antibody variable domain
MKLPVRLLVLMFWIPASLSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 848 - protein, 105 aa, Homo sapiens; identical to SEQ ID NO: 801

SEQ ID NO: 849 - protein, 102 aa, Homo sapiens; identical to SEQ ID NO: 802

SEQ ID NO: 850 - protein, 569 aa, Homo sapiens
EVQLVESGGGLVQPGGSLRLSCAASGFTVSGSYMSWVRQAPGKGLEWVSVIYSGGSTYYADSVKGRFTISRDNSKNTLYLQMNSLRAEDTAVYYCARDLRGSYDYWGQGTLVIVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 851 - protein, 219 aa, Homo sapiens
EIVLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 852 - protein, 240 aa, Artificial Sequence; identical to SEQ ID NO: 821
  Description of Artificial Sequence: Synthetic antibody variable domain

SEQ ID NO: 853 - protein, 462 aa, Artificial Sequence; identical to SEQ ID NO: 822
  Description of Artificial Sequence: Synthetic antibody variable domain

SEQ ID NO: 854 - protein, 113 aa, Artificial Sequence; identical to SEQ ID NO: 816
  Description of Artificial Sequence: Synthetic antibody variable domain

SEQ ID NO: 855 - protein, 113 aa, Artificial Sequence; identical to SEQ ID NO: 815
  Description of Artificial Sequence: Synthetic antibody variable domain

SEQ ID NO: 856 - protein, 240 aa, Artificial Sequence; identical to SEQ ID NO: 821
  Description of Artificial Sequence: Synthetic antibody variable domain

SEQ ID NO: 857 - protein, 462 aa, Artificial Sequence; identical to SEQ ID NO: 822
  Description of Artificial Sequence: Synthetic antibody variable domain

SEQ ID NO: 858 - protein, 137 aa, Mus musculus
MKLWLNWIFLVTLLNGFQCEVKLVESGGGLVLPGDSLRLSCATSEFTFTDYYMTWVRQPPRKALEWLGFIRNRANGYTTEYNPSVKGRFTISRDNSQILYLQMNTLRTEDSATYYCARVSNWAFDYWGQTTLTVSSA

SEQ ID NO: 859 - protein, 133 aa, Mus musculus
MKLPVRLLVLMFWIPGSSSDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLELKRT

SEQ ID NO: 860 - protein, 112 aa, Artificial Sequence
  Description of Artificial Sequence: Synthetic antibody variable domain
DVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 861 - protein, 119 aa, Artificial Sequence
  Description of Artificial Sequence: Synthetic antibody variable domain
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSS

SEQ ID NO: 862 - protein, 112 aa, Mus musculus; identical to SEQ ID NO: 860

SEQ ID NO: 863 - protein, 119 aa, Mus musculus; identical to SEQ ID NO: 861

SEQ ID NO: 864 - protein, 112 aa, Mus musculus
DVVMTQTPLSLPVSDQASISCRSSQSLLLGKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 865 - protein, 119 aa, Mus musculus; identical to SEQ ID NO: 861

SEQ ID NO: 866 - protein, 112 aa, Artificial Sequence; identical to SEQ ID NO: 860
  Description of Artificial Sequence: Synthetic antibody variable domain

SEQ ID NO: 867 - protein, 119 aa, Artificial Sequence; identical to SEQ ID NO: 861
  Description of Artificial Sequence: Synthetic antibody variable domain

SEQ ID NO: 868 - protein, 115 aa, Artificial Sequence
  Description of Artificial Sequence: Synthetic antibody variable domain
EVQLQQSGPELVKPGASVKISCKASGYTFTDYYMNWVKQSHGKSLEWIGDINPNNGGTSYNQKFKGKATLTVDKSSSTAYMELRSLTSEDSAVYYCATYGLGGYWGQGTTLTVSS

SEQ ID NO: 869 - protein, 108 aa, Artificial Sequence
  Description of Artificial Sequence: Synthetic antibody variable domain
GNIVMTQSPKSMSMSVGERVTQTCKASENVVTYVSWYQLKPEQSPKLLIYGASNRYTGVPDRFTGSGSATDFTLTISSVQAEDLADYHCGQGYSYPYTFGGGTKLEIK

SEQ ID NO: 870 - protein, 115 aa, Artificial Sequence
  Description of Artificial Sequence: Synthetic antibody variable domain
EVQLVESGGGLVKPGGSLKLSCAASGFTFSSYAMSWVRQTPEKRLEWVATISDGGYYTYYPDNVKGRFTISRDNAKNNLYLQMSHLKSGDTAMYYCARYDSFDYWGQGTTLTVSS

SEQ ID NO: 871 - protein, 111 aa, Artificial Sequence
  Description of Artificial Sequence: Synthetic antibody variable domain
GDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTTFGGGTKLEIK

SEQ ID NO: 872 - protein, 518 aa, Artificial Sequence
  Description of Artificial Sequence: Synthetic scFv sequence
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSQVQLVQSGGGLTLSKADYEKHKVYACEVTHQGLSSPVTKSFNRGECGGGGSGGGGSQVQLVQSGGGVVQPGRSLRLSCKASGYTFTRYTMHWVRQAPGKCLEWIGYINPSRGYTNYNQKFKDRFTISRDNSKNTAFLQMDSLRPEDTGVYFCARYYDDHYCLDYWGQGTPVTVSSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGCGTKLQITR

SEQ ID NO: 873 - protein, 524 aa, Artificial Sequence
  Description of Artificial Sequence: Synthetic scFv sequence
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSASHVKLQESGPLTLSKADYEKHKVYACEVTHQGLSSPVTKSFNRGECGGGGSGGGGSASHVKLQESGPGLVQPSQSLSLTCTVSGFSLTDYGVHWVRQSPGKGLEWLGVIWSGGGTAYNTALISRLNIYRDNSKNQVFLEMNSLQAEDTAMYYCARRGSYPYNYFDAWGCGTTVTVSSGGGGSGGGGSGGGGSQAVVIQESALTTPPGETVTLTCGSSTGAVTASNYANWVQEKPDHCFTGLIGGHNNRPPGVPARFSGSLIGDKAALTIAGTQTEDEAIYFCALWYSDHWVIGGGTRLTVLG

SEQ ID NO: 874 - protein, 248 aa, Artificial Sequence
  Description of Artificial Sequence: Synthetic scFv sequence
HMQVQLQQPGAELVKPGASVKLSCKASGYTFTRYWMHWVRQRPGQGLEWIGEINPMDSRTNYNKKFKSKATLTVDKSSSTAYMQLSSLKSEDSAVYYCARPGRARGMDYWGQGNSVTVSSGGGGSGGGGSGGGGSGNIVLTQSPASLAVSLGQRAIISCLYGESVESYGNNFMHWYQQKPGQAPKLLIYLASNLESGVPARFSGSGSRTDFTLTIDPVEADDAATYYCQQNNEDPTFGGGTKLEIKKA

SEQ ID NO: 875 - protein, 225 aa, Artificial Sequence
  Description of Artificial Sequence: Synthetic scFv sequence
EVQLQQSGPELVKPGASVKISCKASGYTFTDYYMNWVKQSHGKSLEWIGDINPNNGGTSYNQKFKGKATLTVDKSSSTAYMELRSLTSEDSAVYYCATYGLGGYWGQGTTLTVSSGNIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEVKKA

SEQ ID NO: 876 - protein, 244 aa, Artificial Sequence
  Description of Artificial Sequence: Synthetic scFv sequence
MEVQLVESGGGLVKPGGSLKLSCAASGFTFSSYAMSWARQTPEKRLEWVATISDGGYYTYYPDNVKGRFTISRDNAKNNLYLQMSHLKSGDTAMYYCARYDSFDYWGQGTTLTVSSGGGGSGGGGSRGGGSGDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTTFGGGTKLEIKKA

SEQ ID NO: 877 - protein, 230 aa, Artificial Sequence
  Description of Artificial Sequence: Synthetic scFv sequence
MQVQLQQPGAELVKPGASVKLSCKASGYTFTRYWMHWVRQRPGQGLEWIGEINPSNGRTNYNEKFKSKATLTVDKSSSTAYMQLSSLKSEDSAVYYCARPGRARGMDYWGQGNSVTVSSGNIVLTQSPASLAVSLGQRATISCRASESVESYGNNFMHWYQQKPGQAPKLLIYLASNLESGVPARFSGSGSRTDFTLTIDPVEADDAATYYCQQNNEDPTFGGGTKLEIK

SEQ ID NO: 878 - protein, 241 aa, Artificial Sequence
  Description of Artificial Sequence: Synthetic scFv sequence
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 879 - protein, 249 aa, Artificial Sequence
  Description of Artificial Sequence: Synthetic scFv sequence
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSSGSTSGSGKPGSSEGSTKGDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 880 - protein, 244 aa, Artificial Sequence
  Description of Artificial Sequence: Synthetic scFv sequence
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGSTSGSGKPGSSEGSTKGDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 881 - protein, 243 aa, Artificial Sequence
  Description of Artificial Sequence: Synthetic scFv sequence
QVQLKESGPVLVAPSQTLSITCTVSGFSLASYNIHVWRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKR

SEQ ID NO: 882 - protein, 241 aa, Artificial Sequence
  Description of Artificial Sequence: Synthetic scFv sequence
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKR

SEQ ID NO: 883 - protein, 239 aa, Artificial Sequence
  Description of Artificial Sequence: Synthetic scFv sequence
EIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 884 - protein, 239 aa, Artificial Sequence
  Description of Artificial Sequence: Synthetic scFv sequence
EIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 885 - protein, 239 aa, Artificial Sequence
  Description of Artificial Sequence: Synthetic scFv sequence
KIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 886 - protein, 239 aa, Artificial Sequence
  Description of Artificial Sequence: Synthetic scFv sequence
KIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 887 - protein, 239 aa, Artificial Sequence
  Description of Artificial Sequence: Synthetic scFv sequence
KIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 888 - protein, 239 aa, Artificial Sequence
  Description of Artificial Sequence: Synthetic scFv sequence
KIVMTQTPATLSVSAGERVTITCKASQSVSNHVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 889 - protein, 239 aa, Artificial Sequence
  Description of Artificial Sequence: Synthetic scFv sequence
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAIGITNYNSAFMSRLTISKDNSKNTVYLQMNSLRAEDTAMYYCASRGGHYGYALDYWGQGTLVTVSS

SEQ ID NO: 890 - protein, 239 aa, Artificial Sequence
  Description of Artificial Sequence: Synthetic scFv sequence
EIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 891 - protein, 239 aa, Artificial Sequence
  Description of Artificial Sequence: Synthetic scFv sequence
EIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 892 - protein, 239 aa, Artificial Sequence
  Description of Artificial Sequence: Synthetic scFv sequence
EIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 893 - protein, 239 aa, Artificial Sequence
  Description of Artificial Sequence: Synthetic scFv sequence
EIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 894 - protein, 239 aa, Artificial Sequence
  Description of Artificial Sequence: Synthetic scFv sequence
KIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 895 - protein, 239 aa, Artificial Sequence
  Description of Artificial Sequence: Synthetic scFv sequence
KIVMTQTPATLSVSAGERVTITCRASQSVSNDVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 896 - protein, 239 aa, Artificial Sequence
  Description of Artificial Sequence: Synthetic scFv sequence
KIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTKLEIKRGGGGSGGGGSGGGGSQVQLVESGPGVVQPGRSLRLSCAVSGFSVTNYGVHWVRQPPGKGLEWLGVIWAGGITNYNSSVKGRLTISKDNSKNTVYLQMNSLRAEDTAVYYCASRGGHYGYALDYWGQGTLVTVSS

SEQ ID NO: 897 - protein, 100 aa, Artificial Sequence
  Description of Artificial Sequence: Synthetic scFv sequence
KIVMTQTPATLSVSAGERVTITCRASQSVSNHVTWYQQKPGQAPRLLIYSASNRYTGIPARFSGSGYGTEFTFTISSVQSEDFAVYFCQQDYSSFGQGTK

SEQ ID NO: 898 - protein, 139 aa, Artificial Sequence
  Description of Artificial Sequence: Synthetic scFv sequence
LEIKRGGGGSGGGGSGGGGSQVQLVESGPGVVQPGRSLRLSCAVSGFSVTNYGVHWVRQPPGKGLEWLGVIWAIGITNYNSSVKGRLTISKDNSKNTVYLQMNSLRAEDTAVYYCASRGGHYGYALDYWGQGTLVTVSS

SEQ ID NO: 899 - protein, 243 aa, Artificial Sequence
  Description of Artificial Sequence: Synthetic scFv sequence
QVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKR

SEQ ID NO: 900 - protein, 242 aa, Artificial Sequence
  Description of Artificial Sequence: Synthetic scFv sequence
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKR

SEQ ID NO: 901 - protein, 115 aa, Artificial Sequence
  Description of Artificial Sequence: Synthetic antibody variable domain
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVS

SEQ ID NO: 902 - protein, 111 aa, Artificial Sequence
  Description of Artificial Sequence: Synthetic antibody variable domain
DIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIK

SEQ ID NO: 903 - protein, 117 aa, Artificial Sequence
  Description of Artificial Sequence: Synthetic antibody variable domain
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSS

SEQ ID NO: 904 - protein, 228 aa, Artificial Sequence
  Description of Artificial Sequence: Synthetic antibody variable domain
DIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSS

SEQ ID NO: 905 - protein, 120 aa, Artificial Sequence
  Description of Artificial Sequence: Synthetic antibody variable domain
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSS

SEQ ID NO: 906 - protein, 115 aa, Artificial Sequence
  Description of Artificial Sequence: Synthetic antibody variable domain
DIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVS

SEQ ID NO: 907 - protein, 118 aa, Artificial Sequence
  Description of Artificial Sequence: Synthetic antibody variable domain
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSS

SEQ ID NO: 908 - protein, 113 aa, Artificial Sequence
  Description of Artificial Sequence: Synthetic antibody variable domain
NIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKR

SEQ ID NO: 909 - protein, 119 aa, Artificial Sequence
  Description of Artificial Sequence: Synthetic antibody variable domain
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSS

SEQ ID NO: 910 - protein, 112 aa, Artificial Sequence
  Description of Artificial Sequence: Synthetic antibody variable domain
DIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIK

SEQ ID NO: 911 - protein, 119 aa, Artificial Sequence
  Description of Artificial Sequence: Synthetic antibody variable domain
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSS

SEQ ID NO: 912 - protein, 112 aa, Artificial Sequence
  Description of Artificial Sequence: Synthetic antibody variable domain
DIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIK

SEQ ID NO: 913 - protein, 117 aa, Artificial Sequence
  Description of Artificial Sequence: Synthetic antibody variable domain
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 914 - protein, 111 aa, Artificial Sequence
  Description of Artificial Sequence: Synthetic antibody variable domain
DIVLTGSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK

SEQ ID NO: 915 - protein, 117 aa, Artificial Sequence
  Description of Artificial Sequence: Synthetic antibody variable domain
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGRGTTLTVSS

SEQ ID NO: 916 - protein, 111 aa, Artificial Sequence
  Description of Artificial Sequence: Synthetic antibody variable domain
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 917 - protein, 120 aa, Artificial Sequence [sequence omitted]

SEQ ID NO: 918 - protein, 107 aa, Artificial Sequence [sequence omitted]

SEQ ID NO: 919 - protein, 109 aa, Artificial Sequence
  Description of Artificial Sequence: Synthetic antibody variable domain
DIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQGTKVEIKRT

SEQ ID NO: 920 - protein, 120 aa, Artificial Sequence
  Description of Artificial Sequence: Synthetic antibody variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 921 - protein, 109 aa, Artificial Sequence
  Description of Artificial Sequence: Synthetic antibody variable domain
DIQMTQSPSSLSASVGDRVTITCRASQDVSSYLAWYQQKPGKAPKLLIYAASSLESGVPSRFSGSGSGTDFTLTISSLQPEDFATYYCQQYNSLPYTFGQGTKVEIKRT

SEQ ID NO: 922 - protein, 120 aa, Artificial Sequence
  Description of Artificial Sequence: Synthetic antibody variable domain
EVQLVESGGGLVQPGGSLRLSCAASGFTFSDYAMSWVRQAPGKGLEWVAVISENGSDTYYADSVKGRFTISRDDSKNTLYLQMNSLRAEDTAVYYCARDRGGAVSYFDVWGQGTLVTVSS

SEQ ID NO: 923 - protein, 109 aa, Artificial Sequence
  Description of Artificial Sequence: Synthetic antibody variable domain
DIVMTQSHKFMSTSVGDRVSITCKASQDVNTAVAWYQQKPGHSPKLLIYSASFRYTGVPDRFTGNRSGTDFTFTISSVQAEDLAVYYCQQHYTTPPTFGGGTKLEIKRA

SEQ ID NO: 924 - protein, 120 aa, Artificial Sequence
  Description of Artificial Sequence: Synthetic antibody variable domain
EVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 925 - protein, 20 aa, Artificial Sequence
  Description of Artificial Sequence: Synthetic antibody variable domain
EVQLVESGGGLVQPKGSLKL

SEQ ID NO: 926 - protein, 20 aa, Artificial Sequence
  Description of Artificial Sequence: Synthetic antibody variable domain
DIVMTQSQKFMSTSVVDRIS

SEQ ID NO: 927 - protein, 107 aa, Mus musculus
DTVMTQSHKIMSTSVGDRVSITCKASQDVSIGVAWYQQRPGQSPKLLIYSASYRYTGVPDRFTGSGSGTDFTFTISSVQAEDLAVYYCQQYYIYPYTFGGGTKLEIK

SEQ ID NO: 928 - protein, 119 aa, Mus musculus
EVQLQQSGPELVKPGTSVKISCKASGFTFTDYTMDWVKQSHGKSLEWIGDVNPNSGGSIYNQRFKGKASLTVDRSSRIVYMELRSLTFEDTAVYYCARNLGPSFYFDYWGQGTTLTVSS

SEQ ID NO: 929 - protein, 107 aa, Artificial Sequence [sequence omitted]

SEQ ID NO: 930 - protein, 119 aa, Artificial Sequence [sequence omitted]

SEQ ID NO: 931 - protein, 107 aa, Artificial Sequence
  Description of Artificial Sequence: Synthetic antibody variable domain
DIQMTQSPSSLSASVGDRVTITCRASQSISNYLAWYQQKPGKAPKLLIYAASSLESGVPSRFSGSGSGTDFTLTISSLQPEDFATYYCQQYNSLPWTFGQGTKVEIK

SEQ ID NO: 932 - protein, 119 aa, Artificial Sequence
  Description of Artificial Sequence: Synthetic antibody variable domain
EVQLVESGGGLVQPGGSLRLSCAASGFTFSSYAMSWVRQAPGKGLEWVAVISGDGGSTYYADSVKGRFTISRDNSKNTLYLQMNSLRAEDTAVYYCARGRVGYSLYDYWGQGTLVTVSS

SEQ ID NO: 933 - protein, 214 aa, Artificial Sequence
  Description of Artificial Sequence: Synthetic antibody variable domain
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 934 - protein, 448 aa, Artificial Sequence
  Description of Artificial Sequence: Synthetic antibody variable domain
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 935 - protein, 214 aa, Artificial Sequence
  Description of Artificial Sequence: Synthetic antibody variable domain
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 936 - protein, 449 aa, Artificial Sequence
  Description of Artificial Sequence: Synthetic antibody variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 937 - protein, 217 aa, Artificial Sequence
  Description of Artificial Sequence: Synthetic antibody variable domain
VHSDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 938 - protein, 449 aa, Artificial Sequence
  Description of Artificial Sequence: Synthetic antibody variable domain
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 939 - protein, 124 aa, Homo sapiens
EVQLLESGGGLVQPGGSLRLSCAASGFTFSSYAMTWVRQAPGKGLEWVSAISGSGYSTYYADSEKGRFTISRDNSKNTLYLQMNSLRAEDTAVYYCAKGFQYGSGSYYTHFDYWGQGTLVTVSS

SEQ ID NO: 940 - protein, 107 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 941 - protein, 122 aa, Homo sapiens
QVQLVESGGGVVQPGRSLRLSCAASGFTFSSYDIHWVRQAPGKGLEWVAVIWYDGSNKYHADSVKGRFTISRDNSKNTLYLQMNSLRAEDTAVYYCARNYGLGSYYNYFDFWGQGTLVTVSS

SEQ ID NO: 942 - protein, 107 aa, Homo sapiens
DIQMTQSPSSLSASVGDRVTITCRASHGISSWLAWYQQKPEKAPKSLIYAASSLQSGVPSRFSGSGSGTDFTLTISSLQPEDFATYYCQQYNSYPYTFGQGTKLEIK

SEQ ID NO: 943 - protein, 122 aa, Homo sapiens
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCALMVRGLIITGYFDYWGQGTLVTVSS

SEQ ID NO: 944 - protein, 108 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPPYTFGQGTKLEIK

SEQ ID NO: 945 - protein, 109 aa, Artificial Sequence
  Description of Artificial Sequence: Synthetic antibody variable domain
DTVMTQSHKIMSTSVGDRVSITCKASQDVSIGVAWYQQRPGQSPKLLIYSASYRYTGVPDRFTGSGSGTDFTFTISSVQAEDLAVYYCQQYYIYPYTFGGGTKLEIKRT

SEQ ID NO: 946 - protein, 109 aa, Artificial Sequence
  Description of Artificial Sequence: Synthetic antibody variable domain
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRT

SEQ ID NO: 947 - protein, 109 aa, Artificial Sequence
  Description of Artificial Sequence: Synthetic antibody variable domain
DIQMTQSPSSLSASVGDRVTITCRASQSISNYLAWYQQKPGKAPKLLIYAASSLESGVPSRFSGSGSGTDFTLTISSLQPEDFATYYCQQYNSLPWTFGQGTKVEIKRT

SEQ ID NO: 948 - protein, 228 aa, Artificial Sequence
  Description of Artificial Sequence: Synthetic antibody variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 949 - protein, 109 aa, Artificial Sequence
  Description of Artificial Sequence: Synthetic antibody variable domain
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRT

SEQ ID NO: 950 - protein, 142 aa, Artificial Sequence
  Description of Artificial Sequence: Synthetic antibody variable domain
MDFQVQIFSFLLISASVIISRGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 951 - protein, 130 aa, Artificial Sequence
  Description of Artificial Sequence: Synthetic antibody variable domain
MDFQVQIFSFLLISASVIISRGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 952 - protein, 472 aa, Artificial Sequence
  Description of Artificial Sequence: Synthetic antibody variable domain
MDFQVQIFSFLLISASVIISRGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEPEVKFNWYVDDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 953 - protein, 236 aa, Artificial Sequence
  Description of Artificial Sequence: Synthetic antibody variable domain
MDFQVQIFSFLLISASVIISRGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 954 - protein, 628 aa, Artificial Sequence
  Description of Artificial Sequence: Synthetic antibody variable domain
MDFQVQIFSFLLISASVIISRGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEPEVKFNWYVDDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAP

SEQ ID NO: 955 - protein, 643 aa, Artificial Sequence
  Description of Artificial Sequence: Synthetic antibody variable domain
MDFQVQIFSFLLISASVIISRGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEPEVKFNWYVDDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAP

SEQ ID NO: 956 - protein, 214 aa, Mus musculus
DIQMTQSPSSLSASVGDRVTITCRASQDVNTAVAWYQQKPGKAPKLLIYSASFLYSGVPSRFSGSRSGTDFTLTTSSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 957 - protein, 220 aa, Mus musculus
EVQLVESGGGLVQPGGSLRLSCAASGFNIKDTYIHWVRQAPGKGLEWVARTYPTNGYTRYADSVKGRFTISADTSKNTAYLQMNSLPAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSTVTVPSSSLGTQTYICNVNHKPSNTKVDKKVEP

SEQ ID NO: 958 - protein, 233 aa, Artificial Sequence
  Description of Artificial Sequence: Synthetic antibody variable domain
MGWSCIILFLVATATGVHSDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 959 - protein, 467 aa, Artificial Sequence
  Description of Artificial Sequence: Synthetic antibody variable domain
MGWSCIILFLVATATGVHSEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 960 - protein, 219 aa, Artificial Sequence
  Description of Artificial Sequence: Synthetic antibody variable domain
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 961 - protein, 234 aa, Artificial Sequence
  Description of Artificial Sequence: Synthetic antibody variable domain
QVQLLEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGAQSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKHHHHHH

SEQ ID NO: 962 - protein, 450 aa, Artificial Sequence
  Description of Artificial Sequence: Synthetic antibody variable domain
EVQLVESGGGLVQPGGSLRLSCAASGFNIKDTYIHWVRQAPGKGLEWVARIYPTNGYTRYADSVKGRFTISADTSKNTAYLQMNSLRCEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 963 - protein, 450 aa, Artificial Sequence
  Description of Artificial Sequence: Synthetic antibody variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 964 - protein, 214 aa, Artificial Sequence
  Description of Artificial Sequence: Synthetic antibody variable domain
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTCAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 965 - protein, 129 aa, Artificial Sequence
  Description of Artificial Sequence: Synthetic antibody variable domain
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSS

SEQ ID NO: 966 - protein, 111 aa, Artificial Sequence
  Description of Artificial Sequence: Synthetic antibody variable domain
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKVTVLG

SEQ ID NO: 967 - protein, 121 aa, Artificial Sequence
  Description of Artificial Sequence: Synthetic antibody variable domain
EVQLLEWGPGLVKPSGTLSLTCAVSGGSIRDSNWWGWVRQPPGKGLEWIGEIYHSGTTNYNPSLKSRVTISVDKSKNQFSLNLSSVTAADTAVYYCAREDCSYGSCYFDYWGQGTLVTVSS

SEQ ID NO: 968 - protein, 107 aa, Artificial Sequence
  Description of Artificial Sequence: Synthetic antibody variable domain
ELTLTQSPSSLSASLGDRVTIRCRASQSISAALNWYQQKPGKAPKLLIHDVSTLQSGVPARFSGGGSETDFTLTISSLQPEDFATYYCQQSYRVPLTFGGGTRLEIK

SEQ ID NO: 969 - protein, 451 aa, Artificial Sequence
  Description of Artificial Sequence: Synthetic antibody variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 970 - protein, 469 aa, Artificial Sequence
  Description of Artificial Sequence: Synthetic antibody variable domain
MECSWVMLFLLSVTAGVHSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 971 - protein, 233 aa, Artificial Sequence
  Description of Artificial Sequence: Synthetic antibody variable domain
MEWSCVMLFLLSVTAGVHSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFEPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 972 - protein, 450 aa, Artificial Sequence
  Description of Artificial Sequence: Synthetic antibody variable domain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 973 - protein, 263 aa, Artificial Sequence
  Description of Artificial Sequence: Synthetic scFv sequence
MAVLGLLFCLVTFPSCVLSQVQVKESGPFLVPPSQSLSITCTVSGFSLTTYGVSWIRQPPGKGLEWLGAIWGDGTTNYHSALISRLSISKDNSKSQVFLKLNSLQTDDTATYYCAKLGNYDALDYWGQGTSVTVSSGGGGSGGGGSGGGGSDVLMTQTPLSLPVSLGDQASISCRSSQSIVHSNGNTYLEWYLQKPGQSPNLLIYFVSNRFSGVPDRFSGSGSGTDFTLKISRVEAEDLGVYYCFQGSHVPWTFGGGTKLEIK

SEQ ID NO: 974 - protein, 242 aa, Artificial Sequence
  Description of Artificial Sequence: Synthetic scFv sequence
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSSGGGGSGGGGSGGGGSETTLTQSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIKR

SEQ ID NO: 975 - protein, 477 aa, Artificial Sequence
  Description of Artificial Sequence: Synthetic scFv sequence
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGAAAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 976 - protein, 291 aa, Artificial Sequence
  Description of Artificial Sequence: Synthetic scFv sequence
MKYLLPTAAAGLLLLAAQPAMAQVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSSGGGGSGGGGSGGGGSQSVLTQPPSVSGAPGQRVTISCTGSSSNIGAGYGVHWYQQLPGTAPKLLIYGNTNRPSGVPDRFSGFKSGTSASLAITGLQAEDEADYYCQSYDSSLSGWVFGGGTKLTVLGAAAEQKLISEEDLNGAAHHHHHH

SEQ ID NO: 977 - protein, 291 aa, Artificial Sequence
  Description of Artificial Sequence: Synthetic scFv sequence
MKYLLPTAAAGLLLLAAQPAMAQVQLVQSGGGLVQPGRSLRLSCAASGFTFDDYAMHWVRQAPGKGLEWVSGISWNSGSIGYADSVKGRFTISRDNAKNSLYLQMNSLRPEDTAVYYCARDLGAKQWLEGFDYWGQGTLVTVSSGGGGSGGGGSGGGGSNFMLTQDPAVSVALGQTVRITCQGDSLRSYYASWYQQKPGQAPVLVIYGKNNRPSGIPDRFSGSTSGNSASLTITGAQAEDEADYYCNSRDSSGNHWVFGGGTKVTVLGAAAEQKLISEEDLNGAAHHHHHH

SEQ ID NO: 978 - protein, 665 aa, Artificial Sequence
  Description of Artificial Sequence: Synthetic scFv sequence
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 979 - protein, 278 aa, Artificial Sequence
  Description of Artificial Sequence: Synthetic scFv sequence
MRFSTTLATAATALFFTASQVSAEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKSGHHHHHH

SEQ ID NO: 980 - protein, 280 aa, Artificial Sequence
  Description of Artificial Sequence: Synthetic scFv sequence
MRFSTTLATAATALFFTASQVSAGHHHHHHSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKS

SEQ ID NO: 981 - protein, 114 aa, Homo sapiens; identical to SEQ ID NO: 480

SEQ ID NO: 982 - protein, 98 aa, Homo sapiens; identical to SEQ ID NO: 481

SEQ ID NO: 983 - protein, 112 aa, Homo sapiens; identical to SEQ ID NO: 482

SEQ ID NO: 984 - protein, 173 aa, Homo sapiens; identical to SEQ ID NO: 483

SEQ ID NO: 985 - protein, 113 aa, Homo sapiens; identical to SEQ ID NO: 484

SEQ ID NO: 986 - protein, 60 aa, Homo sapiens; identical to SEQ ID NO: 485

SEQ ID NO: 987 - protein, 114 aa, Homo sapiens; identical to SEQ ID NO: 486

SEQ ID NO: 988 - protein, 113 aa, Homo sapiens; identical to SEQ ID NO: 487

SEQ ID NO: 989 - protein, 22 aa, Homo sapiens
EGLYNELQKDKMAEAYSEIGMK

SEQ ID NO: 990 - protein, 112 aa, Homo sapiens; identical to SEQ ID NO: 419

SEQ ID NO: 991 - protein, 110 aa, Homo sapiens; identical to SEQ ID NO: 493

SEQ ID NO: 992 - protein, 137 aa, Homo sapiens; identical to SEQ ID NO: 494

SEQ ID NO: 993 - protein, 163 aa, Homo sapiens; identical to SEQ ID NO: 472

SEQ ID NO: 994 - protein, 38 aa, Homo sapiens; identical to SEQ ID NO: 496

SEQ ID NO: 995 - protein, 226 aa, Homo sapiens; identical to SEQ ID NO: 497

SEQ ID NO: 996 - protein, 188 aa, Homo sapiens; identical to SEQ ID NO: 498

SEQ ID NO: 997 - protein, 21 aa, Homo sapiens
ENLYEGLNLDDCSMYEDISRG

SEQ ID NO: 998 - protein, 84 aa, Homo sapiens; identical to SEQ ID NO: 501

SEQ ID NO: 999 - protein, 84 aa, Homo sapiens; identical to SEQ ID NO: 502

SEQ ID NO: 1000 - protein, 47 aa, Homo sapiens; identical to SEQ ID NO: 503

SEQ ID NO: 1001 - protein, 41 aa, Homo sapiens; identical to SEQ ID NO: 504

SEQ ID NO: 1002 - protein, 47 aa, Homo sapiens; identical to SEQ ID NO: 505

SEQ ID NO: 1003 - protein, 20 aa, Homo sapiens
RPRRSPAQDGKVYINMPGRG

SEQ ID NO: 1004 - protein, 113 aa, Homo sapiens; identical to SEQ ID NO: 507

SEQ ID NO: 1005 - protein, 112 aa, Homo sapiens; identical to SEQ ID NO: 508

SEQ ID NO: 1006 - protein, 102 aa, Homo sapiens; identical to SEQ ID NO: 509

SEQ ID NO: 1007 - protein, 101 aa, Homo sapiens; identical to SEQ ID NO: 510

SEQ ID NO: 1008 - protein, 113 aa, Homo sapiens; identical to SEQ ID NO: 507

SEQ ID NO: 1009 - protein, 112 aa, Homo sapiens; identical to SEQ ID NO: 508

SEQ ID NO: 1010 - protein, 102 aa, Homo sapiens; identical to SEQ ID NO: 509

SEQ ID NO: 1011 - protein, 101 aa, Homo sapiens; identical to SEQ ID NO: 510

SEQ ID NO: 1012 - protein, 21 aa, Homo sapiens
ESPYQELQGQRSDVYSDLNTQ

SEQ ID NO: 1013 - protein, 49 aa, Homo sapiens; identical to SEQ ID NO: 517

SEQ ID NO: 1014 - protein, 35 aa, Homo sapiens; identical to SEQ ID NO: 518

SEQ ID NO: 1015 - protein, 39 aa, Homo sapiens; identical to SEQ ID NO: 519

SEQ ID NO: 1016 - protein, 149 aa, Homo sapiens; identical to SEQ ID NO: 520

SEQ ID NO: 1017 - protein, 619 aa, Homo sapiens; identical to SEQ ID NO: 521

SEQ ID NO: 1018 - protein, 180 aa, Homo sapiens; identical to SEQ ID NO: 522

SEQ ID NO: 1019 - protein, 240 aa, Homo sapiens; identical to SEQ ID NO: 523

SEQ ID NO: 1020 - protein, 86 aa, Homo sapiens; identical to SEQ ID NO: 524

SEQ ID NO: 1021 - protein, 21 aa, Homo sapiens
DGVYTGLSTRNQETYETLKHE

SEQ ID NO: 1022 - protein, 66 aa, Homo sapiens; identical to SEQ ID NO: 526

SEQ ID NO: 1023 - protein, 40 aa, Homo sapiens; identical to SEQ ID NO: 451

SEQ ID NO: 1024 - protein, 67 aa, Homo sapiens
IEVMYPPPYLDNEKSNGTIIHVKGKHLCPSPLFPGPSKPFWVLVVVGGVLACYSLLVTVAFIIFWVR

SEQ ID NO: 1025 - protein, 84 aa, Homo sapiens; identical to SEQ ID NO: 501

SEQ ID NO: 1026 - protein, 219 aa, Artificial Sequence
  Description of Artificial Sequence: Synthetic polypeptide
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1027 - protein, 283 aa, Artificial Sequence
  Description of Artificial Sequence: Synthetic polypeptide
FVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1028 - protein, 46 aa, Homo sapiens; identical to SEQ ID NO: 528

SEQ ID NO: 1029 - protein, 31 aa, Homo sapiens; identical to SEQ ID NO: 529

SEQ ID NO: 1030 - protein, 27 aa, Homo sapiens
IISFFLALTSTALLFLLFFLTLRFSVV

SEQ ID NO: 1031 - protein, 26 aa, Homo sapiens
VAAILGLGLVLGLLGPLAILLALYLL

SEQ ID NO: 1032 - protein, 363 aa, Homo sapiens; identical to SEQ ID NO: 532

SEQ ID NO: 1033 - protein, 21 aa, Homo sapiens
AVFGCIFGALVIVTVGGFIFW

SEQ ID NO: 1034 - protein, 185 aa, Homo sapiens; identical to SEQ ID NO: 534

SEQ ID NO: 1035 - protein, 106 aa, Homo sapiens; identical to SEQ ID NO: 535

SEQ ID NO: 1036 - protein, 27 aa, Homo sapiens
FWVLVVVGGVLACYSLLVTVAFIIFWV

SEQ ID NO: 1037 - protein, 66 aa, Homo sapiens; identical to SEQ ID NO: 537

SEQ ID NO: 1038 - protein, 33 aa, Homo sapiens; identical to SEQ ID NO: 538

SEQ ID NO: 1039 - protein, 68 aa, Homo sapiens; identical to SEQ ID NO: 449

SEQ ID NO: 1040 - protein, 28 aa, Homo sapiens
MFWVLVVVGGVLACYSLLVTVAFIIFWV

SEQ ID NO: 1041 - protein, 26 aa, Homo sapiens
FWVLVVVGGVLACYSLLVTVAFHFWV

SEQ ID NO: 1042 - protein, 28 aa, Homo sapiens
MFWVLVVVGGVLACYSGGVTVAFIIFWV

SEQ ID NO: 1043 - protein, 26 aa, Homo sapiens
WVLVVVGGVLACYSLLVTVAFIIFWV

SEQ ID NO: 1044 - protein, 69 aa, Homo sapiens; identical to SEQ ID NO: 544

SEQ ID NO: 1045 - protein, 180 aa, Homo sapiens; identical to SEQ ID NO: 545

SEQ ID NO: 1046 - protein, 216 aa, Homo sapiens; identical to SEQ ID NO: 546

SEQ ID NO: 1047 - protein, 140 aa, Homo sapiens; identical to SEQ ID NO: 547

SEQ ID NO: 1048 - protein, 222 aa, Homo sapiens; identical to SEQ ID NO: 454

SEQ ID NO: 1049 - protein, 23 aa, Homo sapiens
LCYLLDGILFIYGVILTALFLRV

SEQ ID NO: 1050 - protein, 51 aa, Homo sapiens; identical to SEQ ID NO: 550

SEQ ID NO: 1051 - protein, 21 aa, Homo sapiens
LCYLLDGILFIYGVILTALFL

SEQ ID NO: 1052 - protein, 25 aa, Homo sapiens
ALIVLGGVAGLLLFIGLGIFFCVRC

SEQ ID NO: 1053 - protein, 22 aa, Homo sapiens
MALIVLGGVAGLLLFIGLGIFF

SEQ ID NO: 1054 - protein, 725 aa, Homo sapiens; identical to SEQ ID NO: 554

SEQ ID NO: 1055 - protein, 23 aa, Homo sapiens
PLFIPVAVMVTAFSGLAFIIWLA

SEQ ID NO: 1056 - protein, 24 aa, Homo sapiens
ALPAALAVISFLLGLGLGVACVLA

SEQ ID NO: 1057 - protein, 21 aa, Homo sapiens
MALPVTALLLPLALLLHAARP

SEQ ID NO: 1058 - protein, 286 aa, Homo sapiens; identical to SEQ ID NO: 558

SEQ ID NO: 1059 - protein, 226 aa, Homo sapiens; identical to SEQ ID NO: 559

SEQ ID NO: 1060 - protein, 83 aa, Homo sapiens; identical to SEQ ID NO: 560

SEQ ID NO: 1061 - protein, 22 aa, Homo sapiens
IWAPLAGTCGVLLLSLVITLYC

SEQ ID NO: 1062 - protein, 24 aa, Homo sapiens
IYIWAPLAGTCGVLLLSLVITLYC

SEQ ID NO: 1063 - protein, 25 aa, Homo sapiens
IYIWAPLAGTCGVLLLSLVITLYCR

SEQ ID NO: 1064 - protein, 25 aa, Homo sapiens
IYIWAPLAGTCGVLLLSLVITLVCR

SEQ ID NO: 1065 - protein, 21 aa, Homo sapiens
IYIWAPLAGTCGVLLLSLVIT

SEQ ID NO: 1066 - protein, 23 aa, Homo sapiens
IYIWAPLAGTCGVLLLSLVITLY

SEQ ID NO: 1067 - protein, 23 aa, Homo sapiens
LGLLVAGVLVLLVSLGVAIHLCC

SEQ ID NO: 1068 - protein, 101 aa, Homo sapiens; identical to SEQ ID NO: 568

SEQ ID NO: 1069 - protein, 257 aa, Homo sapiens; identical to SEQ ID NO: 570

SEQ ID NO: 1070 - protein, 54 aa, Homo sapiens; identical to SEQ ID NO: 573

SEQ ID NO: 1071 - protein, 31 aa, Homo sapiens; identical to SEQ ID NO: 574

SEQ ID NO: 1072 - protein, 24 aa, Homo sapiens
SIISAVVGILLVVVLGVVFGILII

SEQ ID NO: 1073 - protein, 113 aa, Homo sapiens; identical to SEQ ID NO: 576

SEQ ID NO: 1074 - protein, 21 aa, Homo sapiens
FWLPIGCAAFVVVCILGCILI

SEQ ID NO: 1075 - protein, 233 aa, Homo sapiens; identical to SEQ ID NO: 585

SEQ ID NO: 1076 - protein, 21 aa, Homo sapiens
VAAILGLGLVLGLLGPLAILL

SEQ ID NO: 1077 - protein, 24 aa, Homo sapiens
IYIWAPLAGTCGVLLLSLVITLYC

SEQ ID NO: 1078 - protein, 24 aa, Homo sapiens
IYIWAPLAGTCGVLLLSLVITLYC

SEQ ID NO: 1079 - protein, 5 aa, Homo sapiens
DKTHT

SEQ ID NO: 1080 - protein, 4 aa, Homo sapiens
CPPC

SEQ ID NO: 1081 - protein, 5 aa, Homo sapiens
DKTHT

SEQ ID NO: 1082 - protein, 12 aa, Homo sapiens
ELKTPLGDTTHT

SEQ ID NO: 1083 - protein, 10 aa, Homo sapiens
KSCDKTHTCP

SEQ ID NO: 1084 - protein, 7 aa, Homo sapiens
KCCVDCP

SEQ ID NO: 1085 - protein, 7 aa, Homo sapiens
KYGPPCP

SEQ ID NO: 1086 - protein, 16 aa, Homo sapiens
VEPKSPDKTHTCPPCP

SEQ ID NO: 1087 - protein, 16 aa, Homo sapiens
LDPKSSDKTHTCPPCP

SEQ ID NO: 1088 - protein, 39 aa, Homo sapiens; identical to SEQ ID NO: 599

SEQ ID NO: 1089 - protein, 12 aa, Homo sapiens
GGAVHTRGLDFA

SEQ ID NO: 1090 - protein, 45 aa, Homo sapiens; identical to SEQ ID NO: 601

SEQ ID NO: 1091 - protein, 48 aa, Homo sapiens; identical to SEQ ID NO: 602

SEQ ID NO: 1092 - protein, 79 aa, Homo sapiens; identical to SEQ ID NO: 605

SEQ ID NO: 1093 - protein, 51 aa, Homo sapiens; identical to SEQ ID NO: 606

SEQ ID NO: 1094 - protein, 69 aa, Homo sapiens; identical to SEQ ID NO: 607

SEQ ID NO: 1095 - protein, 44 aa, Homo sapiens; identical to SEQ ID NO: 608

SEQ ID NO: 1096 - protein, 47 aa, Homo sapiens; identical to SEQ ID NO: 609

SEQ ID NO: 1097 - protein, 11 aa, Homo sapiens
LDKTHTCPPCP

SEQ ID NO: 1098 - protein, 101 aa, Homo sapiens; identical to SEQ ID NO: 568

SEQ ID NO: 1099 - protein, 16 aa, Homo sapiens
GLAVSTISSFFPPGYQ

SEQ ID NO: 1100 - protein, 282 aa, Homo sapiens; identical to SEQ ID NO: 614

SEQ ID NO: 1101 - protein, 246 aa, Homo sapiens; identical to SEQ ID NO: 615

SEQ ID NO: 1102 - protein, 45 aa, Homo sapiens; identical to SEQ ID NO: 616

SEQ ID NO: 1103 - protein, 16 aa, Homo sapiens
LEPKSCDKTHTCPPCP

SEQ ID NO: 1104 - protein, 43 aa, Homo sapiens; identical to SEQ ID NO: 618

SEQ ID NO: 1105 - protein, 16 aa, Homo sapiens
ELKTPLGDTHTCPRCP

SEQ ID NO: 1106 - protein, 15 aa, Homo sapiens
EPKSCDTPPPCPRCP

SEQ ID NO: 1107 - protein, 12 aa, Homo sapiens
ESKYGPPCPSCP

SEQ ID NO: 1108 - protein, 12 aa, Homo sapiens
ERKCCVECPPCP

SEQ ID NO: 1109 - protein, 229 aa, Homo sapiens; identical to SEQ ID NO: 624

SEQ ID NO: 1110 - protein, 119 aa, Homo sapiens; identical to SEQ ID NO: 625

SEQ ID NO: 1111 - protein, 282 aa, Homo sapiens; identical to SEQ ID NO: 614

SEQ ID NO: 1112 - protein, 281 aa, Homo sapiens; identical to SEQ ID NO: 627

SEQ ID NO: 1113 - protein, 283 aa, Homo sapiens; identical to SEQ ID NO: 628

SEQ ID NO: 1114 - protein, 58 aa, Homo sapiens; identical to SEQ ID NO: 629

SEQ ID NO: 1115 - protein, 282 aa, Homo sapiens; identical to SEQ ID NO: 614

SEQ ID NO: 1116 - protein, 282 aa, Homo sapiens; identical to SEQ ID NO: 614

SEQ ID NO: 1117 - protein, 281 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPQPGSTTFWAWSVLRVPAPPSPQPATYTCVVSHEDSRTLLNASRSLEVSYVTDH

SEQ ID NO: 1118 - protein, 282 aa, Homo sapiens; identical to SEQ ID NO: 614

SEQ ID NO: 1119 - protein, 234 aa, Homo sapiens; identical to SEQ ID NO: 635

SEQ ID NO: 1120 - protein, 20 aa, Homo sapiens
AEPKSPDKTHTCPPCPKDPK

SEQ ID NO: 1121 - protein, 233 aa, Homo sapiens; identical to SEQ ID NO: 638

SEQ ID NO: 1122 - protein, 13 aa, Homo sapiens
SVFLFPPKPKDTL

SEQ ID NO: 1123 - protein, 231 aa, Homo sapiens; identical to SEQ ID NO: 640

SEQ ID NO: 1124 - protein, 235 aa, Homo sapiens; identical to SEQ ID NO: 641

SEQ ID NO: 1125 - protein, 223 aa, Homo sapiens; identical to SEQ ID NO: 642

SEQ ID NO: 1126 - protein, 235 aa, Homo sapiens; identical to SEQ ID NO: 643

SEQ ID NO: 1127 - protein, 17 aa, Homo sapiens
ELKTPLGDTTHTCPRCP

SEQ ID NO: 1128 - protein, 61 aa, Homo sapiens; identical to SEQ ID NO: 646

SEQ ID NO: 1129 - protein, 230 aa, Homo sapiens; identical to SEQ ID NO: 647

SEQ ID NO: 1130 - protein, 230 aa, Homo sapiens; identical to SEQ ID NO: 648

SEQ ID NO: 1131 - protein, 12 aa, Homo sapiens
SPNMVPHAHHAQ

SEQ ID NO: 1132 - protein, 107 aa, Homo sapiens; identical to SEQ ID NO: 650

SEQ ID NO: 1133 - protein, 129 aa, Homo sapiens; identical to SEQ ID NO: 651

SEQ ID NO: 1134 - protein, 229 aa, Homo sapiens; identical to SEQ ID NO: 653

SEQ ID NO: 1135 - protein, 229 aa, Homo sapiens; identical to SEQ ID NO: 653

SEQ ID NO: 1136 - DNA, 36 bp, Homo sapiens; identical to SEQ ID NO: 655

SEQ ID NO: 1137 - protein, 12 aa, Homo sapiens
ESKYGPPCPPCP

SEQ ID NO: 1138 - protein, 9 aa, Homo sapiens
YGPPCPPCP

SEQ ID NO: 1139 - protein, 10 aa, Homo sapiens
KYGPPCPPCP

SEQ ID NO: 1140 - protein, 13 aa, Homo sapiens
EVVKYGPPCPPCP

SEQ ID NO: 1141 - protein, 229 aa, Homo sapiens; identical to SEQ ID NO: 664

SEQ ID NO: 1142 - protein, 22 aa, Homo sapiens
ESKYGPPCPPCPGGGSSGGGSG

SEQ ID NO: 1143 - protein, 231 aa, Homo sapiens; identical to SEQ ID NO: 666

SEQ ID NO: 1144 - protein, 231 aa, Homo sapiens; identical to SEQ ID NO: 667

SEQ ID NO: 1145 - protein, 236 aa, Homo sapiens
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 1146 - protein, 268 aa, Artificial Sequence
  Description of Artificial Sequence: Synthetic construct
MYRMQLLSCIALSLALVTNSEFSTEFGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEMHAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 1147 - protein, 153 aa, Artificial Sequence
  Description of Artificial Sequence: Synthetic construct
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 1148 - protein, 319 aa, Artificial Sequence
  Description of Artificial Sequence: Synthetic construct
MYRMQLLSCIALSLALVTNSEFSTEFISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRMHAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 1149 - protein, 528 aa, Artificial Sequence
  Description of Artificial Sequence: Synthetic payload sequence
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPESGGGSDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1150 - protein, 579 aa, Artificial Sequence
  Description of Artificial Sequence: Synthetic payload sequence
MISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRSGGGSDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1151 - protein, 607 aa, Artificial Sequence
  Description of Artificial Sequence: Synthetic payload sequence
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDSGGGSDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1152 - protein, 607 aa, Artificial Sequence
  Description of Artificial Sequence: Synthetic payload sequence
MVGSLNCIVAVSQNMGIGKNGDLPWPPLRNEFRYFQRMTTTSSVEGKQNLVIMGKKTWFSIPEKNRPLKGRINLFLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDSGGGSDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1153 - protein, 607 aa, Artificial Sequence
  Description of Artificial Sequence: Synthetic payload sequence
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSADDALKLTEQPELANKVDMVWIVGGSSVYKEAMNHPGHLKLFVTRIMQDFESDAFFPEIDLEKYKLLPEYPGVLSDVQEEKGIKYKFEVYEKNDSGGGSDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1154 - protein, 413 aa, Artificial Sequence
  Description of Artificial Sequence: Synthetic payload sequence
MLEGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESGGGSGVDGFGDVGALESLRGNADLAYILSMEPCGHCLIINNVNFCRESGLRTRTGSNIDCEKLRRRFSSLHFMVEVKGDLTAKKMVLALLELARQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSQLIGMLQGLMRDL

SEQ ID NO: 1155 - protein, 525 aa, Artificial Sequence
  Description of Artificial Sequence: Synthetic payload sequence
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1156 - protein, 576 aa, Artificial Sequence
  Description of Artificial Sequence: Synthetic payload sequence
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1157 - protein, 576 aa, Artificial Sequence
  Description of Artificial Sequence: Synthetic payload sequence
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYKPDDWESVFSEFHDADAQNSHSYCFEILERR

SEQ ID NO: 1158 - protein, 431 aa, Artificial Sequence; identical to SEQ ID NO: 745
  Description of Artificial Sequence: Synthetic payload sequence

SEQ ID NO: 1159 - protein, 396 aa, Artificial Sequence; identical to SEQ ID NO: 747
  Description of Artificial Sequence: Synthetic construct

SEQ ID NO: 1160 - protein, 543 aa, Artificial Sequence
  Description of Artificial Sequence: Synthetic construct
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPESGGGSPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 1161 - protein, 594 aa, Artificial Sequence
  Description of Artificial Sequence: Synthetic construct
MISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRSGGGSPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 1162 - protein, 540 aa, Artificial Sequence
  Description of Artificial Sequence: Synthetic construct
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGPSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1163 - protein, 591 aa, Artificial Sequence
  Description of Artificial Sequence: Synthetic construct
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGPSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1164 - protein, 505 aa, Artificial Sequence
  Description of Artificial Sequence: Synthetic construct
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPESGPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 1165 - protein, 556 aa, Artificial Sequence
  Description of Artificial Sequence: Synthetic construct
MISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRSGPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 1166 - protein, 505 aa, Artificial Sequence
  Description of Artificial Sequence: Synthetic construct
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGPSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1167 - protein, 556 aa, Artificial Sequence
  Description of Artificial Sequence: Synthetic construct
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGPSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1168 - protein, 490 aa, Artificial Sequence
  Description of Artificial Sequence: Synthetic construct
MALPVTALLLPLALLLHAARPDIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1169 - protein, 599 aa, Artificial Sequence
  Description of Artificial Sequence: Synthetic construct
MALPVTALLLPLALLLHAARPDIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1170 - protein, 650 aa, Artificial Sequence
  Description of Artificial Sequence: Synthetic construct
MALPVTALLLPLALLLHAARPDIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1171 - protein, 686 aa, Artificial Sequence
  Description of Artificial Sequence: Synthetic construct
MLLLVTSLLLCELPHPAFLLIPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGSGKPGSGEGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSASFETTTPAPRPPTPAPTIASQPLSLRPEACRPAAGGAVHTRGLDFACDGSIYIWAPLAGTCGVLLLSLVITLYCTSKRGRKKLLYIFKQPFMRPVQTTQEEDGCSCRFPEEEEGGCELHMRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1172 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 1173 - protein, 159 aa, Artificial Sequence
  Description of Artificial Sequence: Synthetic destabilizing domain (DD)
MISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1174 - protein, 158 aa, Artificial Sequence
  Description of Artificial Sequence: Synthetic destabilizing domain (DD)
ISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1175 - protein, 158 aa, Artificial Sequence
  Description of Artificial Sequence: Synthetic destabilizing domain (DD)
ISLIAALAVDHVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYKPDDWESVFSEFHDADAQNSHSYCFEILERR

SEQ ID NO: 1176 - protein, 107 aa, Artificial Sequence
  Description of Artificial Sequence: Synthetic destabilizing domain (DD)
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 1177 - protein, 107 aa, Artificial Sequence
  Description of Artificial Sequence: Synthetic destabilizing domain (DD)
GVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1178 - DNA, 561 bp, Homo sapiens
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 1179 - protein, 159 aa, Escherichia coli [sequence omitted]

SEQ ID NO: 1180 - DNA, 477 bp, Artificial Sequence
  Description of Artificial Sequence: Synthetic destabilizing domain (DD)
atgatctctctgattgcggcgctggcagttgaccgcgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgt

SEQ ID NO: 1181 - protein, 239 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1182 - DNA, 717 bp, Artificial Sequence
  Description of Artificial Sequence: Synthetic polynucleotide
atggtttctaaaggtgcggagctgttcaccggtatcgttccgatcctgatcgaactgaacggtgacgtaaacggtcacaaattctctgtttctggtgaaggcgagggtgacgcgacgtacggtaagctgacgctgaagttcatctgcactaccggcaaactgccggttccgtggccgaccctggttaccaccctctcttacggtgttcagtgcttctctcgttacccggaccatatgaaacagcacgacttcttcaaatctgctatgccggaaggttacatccaggaacgtaccatctttttcgaagacgatggtaactataagtctcgtgcagaggttaaattcgagggcgataccctcgtgaaccgcatcgagctgaccggcactgacttcaaggaagacggtaacatcctgggtaacaaaatggaatacaactacaacgctcacaacgtttacatcatgaccgacaaagccaaaaacggtatcaaggttaacttcaaaatccgtcacaacatcgaggatggttctgttcagctggcggaccactaccagcaaaacacccctatcggcgacggtccggtgctgctgccggacaatcactatctgtccacccagtccgcgctgtctaaagaccctaacgaaaaacgtgaccacatgatctacttcggtttcgtgaccgcagcggcaattacccacggtatggacgaactctacaaa

SEQ ID NO: 1183 - protein, 6 aa, Artificial Sequence
  Description of Artificial Sequence: Synthetic linker
GGSGGG

SEQ ID NO: 1184 - DNA, 18 bp, Artificial Sequence
  Description of Artificial Sequence: Synthetic oligonucleotide
ggtggctctggtggtggt

SEQ ID NO: 1185 - DNA, 18 bp, Artificial Sequence
  Description of Artificial Sequence: Synthetic oligonucleotide
ggaggtagtggtggaggc

SEQ ID NO: 1186 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1187 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 1188 - protein, 404 aa, Artificial Sequence
  Description of Artificial Sequence: Synthetic polypeptide
MISLIAALAVDRVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYEPDDWESVFSEFHDADAQNSHSYCFEILERRGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1189 - DNA, 406 bp, Homo sapiens
gggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaa

SEQ ID NO: 1190 - protein, 129 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKIPRCSL

SEQ ID NO: 1191 - DNA, 389 bp, Homo sapiens
atggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaccagaattagcaaataaagtagacatggtctggatagttggtggcagttctgtttataagatacccaggtgttctctctga

SEQ ID NO: 1192 - protein, 97 aa, Homo sapiens [sequence omitted]

SEQ ID NO: 1193 - protein, 187 aa, Homo sapiens
MFLLLNCIVAVSQNMGIGKNGDLPRPPLRNEFRYFQRMTTTSSVEGKQNLVIMGRKTWFSIPEKNRPLKDRINLVLSRELKEPPQGAHFLARSLDDALKLTERPELANKVDMIWIVGGSSVYKEAMNHLGHLKLFVTRIMQDFESDTFFSEIDLEKYKLLPEYPGVLSDVQEGKHIKYKFEVCEKDD

SEQ ID NO: 1194 - DNA, 554 bp, Homo sapiens
atgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaa

SEQ ID NO: 1195 - DNA, 561 bp, Artificial Sequence; identical to SEQ ID NO: 83
  Description of Artificial Sequence: Synthetic destabilizing domain (DD)

SEQ ID NO: 1196 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGRLKLFVTRIMQDFGSDTFFPEIDLEKYKLLPEYPGVLSDVQEEKGIKYKFEVYEKND

SEQ ID NO: 1197 - protein, 187 aa, Artificial Sequence; identical to SEQ ID NO: 4
  Description of Artificial Sequence: Synthetic destabilizing domain (DD)

SEQ ID NO: 1198 - protein, 187 aa, Artificial Sequence; identical to SEQ ID NO: 3
  Description of Artificial Sequence: Synthetic destabilizing domain (DD)

SEQ ID NO: 1199 - protein, 187 aa, Artificial Sequence; identical to SEQ ID NO: 10
  Description of Artificial Sequence: Synthetic destabilizing domain (DD)

SEQ ID NO: 1200 - protein, 187 aa, Artificial Sequence; identical to SEQ ID NO: 6
  Description of Artificial Sequence: Synthetic destabilizing domain (DD)

SEQ ID NO: 1201 - protein, 187 aa, Artificial Sequence; identical to SEQ ID NO: 2
  Description of Artificial Sequence: Synthetic destabilizing domain (DD)

SEQ ID NO: 1202 - protein, 187 aa, Artificial Sequence; identical to SEQ ID NO: 11
  Description of Artificial Sequence: Synthetic destabilizing domain (DD)

SEQ ID NO: 1203 - protein, 187 aa, Artificial Sequence; identical to SEQ ID NO: 8
  Description of Artificial Sequence: Synthetic destabilizing domain (DD)

SEQ ID NO: 1204 - protein, 187 aa, Artificial Sequence; identical to SEQ ID NO: 7
  Description of Artificial Sequence: Synthetic destabilizing domain (DD)

SEQ ID NO: 1205 - protein, 187 aa, Artificial Sequence; identical to SEQ ID NO: 5
  Description of Artificial Sequence: Synthetic destabilizing domain (DD)

SEQ ID NO: 1206 - protein, 187 aa, Artificial Sequence; identical to SEQ ID NO: 9
  Description of Artificial Sequence: Synthetic destabilizing domain (DD)

SEQ ID NO: 1207 - protein, 187 aa, Artificial Sequence; identical to SEQ ID NO: 14
  Description of Artificial Sequence: Synthetic destabilizing domain (DD)

SEQ ID NO: 1208 - protein, 187 aa, Artificial Sequence; identical to SEQ ID NO: 12
  Description of Artificial Sequence: Synthetic destabilizing domain (DD)

SEQ ID NO: 1209 - protein, 187 aa, Artificial Sequence; identical to SEQ ID NO: 23
  Description of Artificial Sequence: Synthetic destabilizing domain (DD)

SEQ ID NO: 1210 - protein, 187 aa, Artificial Sequence; identical to SEQ ID NO: 21
  Description of Artificial Sequence: Synthetic destabilizing domain (DD)

SEQ ID NO: 1211 - protein, 187 aa, Artificial Sequence; identical to SEQ ID NO: 25
  Description of Artificial Sequence: Synthetic destabilizing domain (DD)

SEQ ID NO: 1212 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMGKKTWFSIPGKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGFKYKFEVYEKND

SEQ ID NO: 1213 - protein, 187 aa, Artificial Sequence; identical to SEQ ID NO: 16
  Description of Artificial Sequence: Synthetic destabilizing domain (DD)

SEQ ID NO: 1214 - protein, 187 aa, Artificial Sequence; identical to SEQ ID NO: 19
  Description of Artificial Sequence: Synthetic destabilizing domain (DD)

SEQ ID NO: 1215 - protein, 187 aa, Artificial Sequence; identical to SEQ ID NO: 27
  Description of Artificial Sequence: Synthetic destabilizing domain (DD)

SEQ ID NO: 1216 - protein, 187 aa, Artificial Sequence; identical to SEQ ID NO: 20
  Description of Artificial Sequence: Synthetic destabilizing domain (DD)

SEQ ID NO: 1217 - protein, 187 aa, Artificial Sequence; identical to SEQ ID NO: 26
  Description of Artificial Sequence: Synthetic destabilizing domain (DD)

SEQ ID NO: 1218 - protein, 187 aa, Artificial Sequence; identical to SEQ ID NO: 28
  Description of Artificial Sequence: Synthetic destabilizing domain (DD)

SEQ ID NO: 1219 - protein, 187 aa, Artificial Sequence; identical to SEQ ID NO: 17
  Description of Artificial Sequence: Synthetic destabilizing domain (DD)

SEQ ID NO: 1220 - protein, 187 aa, Artificial Sequence; identical to SEQ ID NO: 24
  Description of Artificial Sequence: Synthetic destabilizing domain (DD)

SEQ ID NO: 1221 - protein, 187 aa, Artificial Sequence; identical to SEQ ID NO: 30
  Description of Artificial Sequence: Synthetic destabilizing domain (DD)

SEQ ID NO: 1222 - protein, 187 aa, Artificial Sequence; identical to SEQ ID NO: 31
  Description of Artificial Sequence: Synthetic destabilizing domain (DD)

SEQ ID NO: 1223 - protein, 187 aa, Artificial Sequence; identical to SEQ ID NO: 52
  Description of Artificial Sequence: Synthetic destabilizing domain (DD)

SEQ ID NO: 1224 - protein, 187 aa, Artificial Sequence; identical to SEQ ID NO: 45
  Description of Artificial Sequence: Synthetic destabilizing domain (DD)

SEQ ID NO: 1225 - protein, 187 aa, Artificial Sequence; identical to SEQ ID NO: 47
  Description of Artificial Sequence: Synthetic destabilizing domain (DD)

SEQ ID NO: 1226 - protein, 187 aa, Artificial Sequence; identical to SEQ ID NO: 46
  Description of Artificial Sequence: Synthetic destabilizing domain (DD)

SEQ ID NO: 1227 - protein, 187 aa, Artificial Sequence; identical to SEQ ID NO: 49
  Description of Artificial Sequence: Synthetic destabilizing domain (DD)

SEQ ID NO: 1228 - protein, 187 aa, Artificial Sequence
  Description of Artificial Sequence: Synthetic destabilizing domain (DD)
MVGSLNCIVAVSQNMGIGKNGDLPWPPLRNEFRYFQRMTTTSSVEGKQNLVIMRKKTWFSIPEKNRPLKGRINLVLSRELKEPPQGAHFLSRSLDDALKLTEQPELANKVDMVWIVGGSSVYKEAMNHPGHLKLFVTRIVQDFESDTFFPEIDLEKYKLLPEYPGVLCDVQEEKGIKYKFEVYEKND

SEQ ID NO: 1229 - protein, 187 aa, Artificial Sequence; identical to SEQ ID NO: 51
  Description of Artificial Sequence: Synthetic destabilizing domain (DD)

SEQ ID NO: 1230 - protein, 186 aa, Artificial Sequence; identical to SEQ ID NO: 57
  Description of Artificial Sequence: Synthetic destabilizing domain (DD)

SEQ ID NO: 1231 - protein, 187 aa, Artificial Sequence; identical to SEQ ID NO: 48
  Description of Artificial Sequence: Synthetic destabilizing domain (DD)

SEQ ID NO: 1232 - protein, 187 aa, Artificial Sequence; identical to SEQ ID NO: 44
  Description of Artificial Sequence: Synthetic destabilizing domain (DD)

SEQ ID NO: 1233 - protein, 187 aa, Artificial Sequence; identical to SEQ ID NO: 70
  Description of Artificial Sequence: Synthetic destabilizing domain (DD)

SEQ ID NO: 1234 - protein, 187 aa, Artificial Sequence; identical to SEQ ID NO: 59
  Description of Artificial Sequence: Synthetic destabilizing domain (DD)

SEQ ID NO: 1235 - protein, 187 aa, Artificial Sequence; identical to SEQ ID NO: 63
  Description of Artificial Sequence: Synthetic destabilizing domain (DD)

SEQ ID NO: 1236 - protein, 187 aa, Artificial Sequence; identical to SEQ ID NO: 67
  Description of Artificial Sequence: Synthetic destabilizing domain (DD)

SEQ ID NO: 1237 - protein, 187 aa, Artificial Sequence; identical to SEQ ID NO: 62
  Description of Artificial Sequence: Synthetic destabilizing domain (DD)

SEQ ID NO: 1238 - protein, 187 aa, Artificial Sequence; identical to SEQ ID NO: 65
  Description of Artificial Sequence: Synthetic destabilizing domain (DD)

SEQ ID NO: 1239 - protein, 187 aa, Artificial Sequence; identical to SEQ ID NO: 64
  Description of Artificial Sequence: Synthetic destabilizing domain (DD)

SEQ ID NO: 1240 - protein, 187 aa, Artificial Sequence; identical to SEQ ID NO: 66
  Description of Artificial Sequence: Synthetic destabilizing domain (DD)

SEQ ID NO: 1241 - protein, 187 aa, Artificial Sequence; identical to SEQ ID NO: 69
  Description of Artificial Sequence: Synthetic destabilizing domain (DD)

SEQ ID NO: 1242 - protein, 187 aa, Artificial Sequence; identical to SEQ ID NO: 68
  Description of Artificial Sequence: Synthetic destabilizing domain (DD)

SEQ ID NO: 1243 - protein, 186 aa, Artificial Sequence; identical to SEQ ID NO: 71
  Description of Artificial Sequence: Synthetic destabilizing domain (DD)

SEQ ID NO: 1244 - protein, 186 aa, Artificial Sequence; identical to SEQ ID NO: 33
  Description of Artificial Sequence: Synthetic destabilizing domain (DD)

SEQ ID NO: 1245 - protein, 186 aa, Artificial Sequence; identical to SEQ ID NO: 42
  Description of Artificial Sequence: Synthetic destabilizing domain (DD)

SEQ ID NO: 1246 - protein, 186 aa, Artificial Sequence; identical to SEQ ID NO: 37
  Description of Artificial Sequence: Synthetic destabilizing domain (DD)

SEQ ID NO: 1247 - protein, 186 aa, Artificial Sequence; identical to SEQ ID NO: 1196
  Description of Artificial Sequence: Synthetic destabilizing domain (DD)

SEQ ID NO: 1248 - protein, 186 aa, Artificial Sequence; identical to SEQ ID NO: 61
  Description of Artificial Sequence: Synthetic destabilizing domain (DD)

SEQ ID NO: 1249 - protein, 186 aa, Artificial Sequence; identical to SEQ ID NO: 55
  Description of Artificial Sequence: Synthetic destabilizing domain (DD)

SEQ ID NO: 1250 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPGYPGVLSDVQEEKGFKYKFEVYEKND

SEQ ID NO: 1251 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEEND

SEQ ID NO: 1252 - protein, 186 aa, Artificial Sequence; identical to SEQ ID NO: 41
  Description of Artificial Sequence: Synthetic destabilizing domain (DD)

SEQ ID NO: 1253 - protein, 186 aa, Artificial Sequence; identical to SEQ ID NO: 56
  Description of Artificial Sequence: Synthetic destabilizing domain (DD)

SEQ ID NO: 1254 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMYHPGHLKLFVTRIMQDFESDTFFPEIDLEKYKLLPEYPGVLSDVQEEKGIKYKFEVYEKND

SEQ ID NO: 1255 - protein, 186 aa, Artificial Sequence
  Description of Artificial Sequence: Synthetic destabilizing domain (DD)
VGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGRLKLFVTRIMQDFGSDTFFPEIDLEKYKLLPEYPGVLSDVQEEKGIKYKFEVYEKND

SEQ ID NO: 1256 - protein, 186 aa, Artificial Sequence
  Description of Artificial Sequence: Synthetic destabilizing domain (DD)
VGSLNCIVAVSQNMGVGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 1257 - protein, 186 aa, Artificial Sequence; identical to SEQ ID NO: 13
  Description of Artificial Sequence: Synthetic destabilizing domain (DD)

SEQ ID NO: 1258 - protein, 187 aa, Artificial Sequence; identical to SEQ ID NO: 15
  Description of Artificial Sequence: Synthetic destabilizing domain (DD)

SEQ ID NO: 1259 - protein, 186 aa, Artificial Sequence; identical to SEQ ID NO: 38
  Description of Artificial Sequence: Synthetic destabilizing domain (DD)

SEQ ID NO: 1260 - protein, 4 aa, Homo sapiens
PEKN

SEQ ID NO: 1261 - DNA, 1650 bp, Artificial Sequence
  Description of Artificial Sequence: Synthetic payload sequence
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtg

SEQ ID NO: 1262 - protein, 9 aa, Artificial Sequence
  Description of Artificial Sequence: Synthetic linker
GGSGGGSGG

SEQ ID NO: 1263 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1264 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVITGKKTWFSIPEKNRPLKGRINLVLSRELKEPPQGAHFLSRSLDDALKLTEQPELANKVDMVWIVGGSSVYKEAMNHPGHLKLFVTIIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1265 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVIMGKKTWFSIPEKNRPLKGRINLFLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1266 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1267 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVIMGKKTWFSIPEKNRPLKGRINNVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1268 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSADDALKLTEQPELANKVDMVWIVGGSSVYKEAMNHPGHLKLFVTRIMQDFESDAFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1269 - protein, 434 aa, Artificial Sequence
  Description of Artificial Sequence: Synthetic polypeptide
MVGSLNCIVAVSQNMGIGKNTDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1270 - protein, 434 aa, Artificial Sequence
  Description of Artificial Sequence: Synthetic polypeptide
MVGSLNCIVAVSQNMGIGKNGDLPWPPLRNEFRYFKRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1271 - protein, 434 aa, Artificial Sequence
  Description of Artificial Sequence: Synthetic polypeptide
MVGSLNCIVAVSQNMGIGKNGDLPWPPLRNEFRYFKRMTTTSSVEGKQNLVIMGKKTWFSIPEKFRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1272 - protein, 434 aa, Artificial Sequence
  Description of Artificial Sequence: Synthetic polypeptide
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSAIKEAMNHPGHLKLFVTRIMQDFESDTFFPEIDLEKYKLLPEYPGVLSDVQEEKGIKYKFEVYEKNDTSGGSGGGMVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 1273 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1274 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVITGKKTWFSIPEKNRPLKGRINLVLSRELKEPPQGAHFLSRSLDDALKLTEQPELANKVDMVWIVGGSSVYKEAMNHPGHLKLFVTIIMQDFESDTFFPEIDLEKYKLLPEYPGVLSDVQEEKGIKYKFEVYEKND

SEQ ID NO: 1275 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLFLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1276 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKND

SEQ ID NO: 1277 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINNVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1278 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSADDALKLTEQPELANKVDMVWIVGGSSVYKEAMNHPGHLKLFVTRIMQDFESDAFFPEIDLEKYKLLPEYPGVLSDVQEEKGIKYKFEVYEKND

SEQ ID NO: 1279 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNTDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1280 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFKRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1281 - protein, 433 aa, Artificial Sequence; identical to SEQ ID NO: 1280
  Description of Artificial Sequence: Synthetic polypeptide

SEQ ID NO: 1282 - protein, 433 aa, Artificial Sequence
  Description of Artificial Sequence: Synthetic polypeptide
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSAIKEAMNHPGHLKLFVTRIMQDFESDTFFPEIDLEKYKLLPEYPGVLSDVQEEKGIKYKFEVYEKND

SEQ ID NO: 1283 - protein, 433 aa, Artificial Sequence
  Description of Artificial Sequence: Synthetic construct
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGSLPWPPLRNEMSYFSRMTTTSSVEGKQNLVIMGKKTWFSIPEKSRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 1284 - protein, 433 aa, Artificial Sequence
  Description of Artificial Sequence: Synthetic construct
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNDMRYFQRMTTTSSVEGKQNLVIMGKKTWFSIPEKNRPLKGRINLVLSRELKEPPQGAHFLSRSLDDALKLTEQPELANKVDMVWIIGGSSVYKEAMNHPGHLKLFVTRIMQDFESDTFFPEIDLEKYKLLPEYPGVLSDVQEEKGIKYKFEVYEKND

SEQ ID NO: 1285 - protein, 433 aa, Artificial Sequence
  Description of Artificial Sequence: Synthetic construct
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGVGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1286 - protein, 433 aa, Artificial Sequence
  Description of Artificial Sequence: Synthetic construct
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIIQDFESDTFFPEIDLEKYKLLPEYPGVLSDVQEEKGIKYKFEVYEKND

SEQ ID NO: 1287 - protein, 433 aa, Artificial Sequence
  Description of Artificial Sequence: Synthetic construct
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMYHPGHLKLFVTRIMQDFESDTFFPEIDLEKYKLLPEYPGVLSDVQEEKGIKYKFEVYEKND

SEQ ID NO: 1288 - protein, 433 aa, Artificial Sequence
  Description of Artificial Sequence: Synthetic construct
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGGSGGGTSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGRLKLFVTRIMQDFGSDTFFPEIDLEKYKLLPEYPGVLSDVQEEKGIKYKFEVYEKND

SEQ ID NO: 1289 - protein, 738 aa, Artificial Sequence
  Description of Artificial Sequence: Synthetic construct
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKDD

SEQ ID NO: 1290 - protein, 738 aa, Artificial Sequence
  Description of Artificial Sequence: Synthetic construct
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIIQDFESDTFFPEIDLEKYKLLPEYPGVLSDVQEEKGIKYKFEVYEKND

SEQ ID NO: 1291 - protein, 738 aa, Artificial Sequence
  Description of Artificial Sequence: Synthetic construct
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMYHPGHLKLFVTRIMQDFESDTFFPEIDLEKYKLLPEYPGVLSDVQEEKGIKYKFEVYEKND

SEQ ID NO: 1292 - protein, 738 aa, Artificial Sequence
  Description of Artificial Sequence: Synthetic construct
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAVSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1293 - protein, 427 aa, Artificial Sequence
  Description of Artificial Sequence: Synthetic construct
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKGSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1294 - protein, 242 aa, Artificial Sequence; identical to SEQ ID NO: 313
  Description of Artificial Sequence: Synthetic CD19 scFv sequence

SEQ ID NO: 1295 - DNA, 726 bp, Artificial Sequence
  Description of Artificial Sequence: Synthetic CD19 scFv sequence
gacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagc

SEQ ID NO: 1296 - DNA, 726 bp, Artificial Sequence
  Description of Artificial Sequence: Synthetic CD19 scFv sequence
gacatccagatgacacagaccacaagctccctgagcgcctccctgggcgacagagtgaccatctcttgccgggccagccaggatatctccaagtatctgaactggtaccagcagaagcccgatggcacagtgaagctgctgatctatcacacctctcgcctgcacagcggcgtgccttccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataactccgccctgaagtctcggctgaccatcatcaaggacaactctaagagccaggtgttcctgaagatgaattccctgcagacagacgataccgccatctactattgcgccaagcactactattacggcggctcctatgccatggattactggggccagggcacatctgtgaccgtgtctagc

SEQ ID NO: 1297 - DNA, 726 bp, Artificial Sequence
  Description of Artificial Sequence: Synthetic CD19 scFv sequence
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgaccatcatcaaggacaactctaagagccaggtgttcctgaagatgaattccctgcagacagacgataccgccatctactattgcgccaagcactactattacggcggctcttatgccatggattactggggccagggcacaagcgtgaccgtgtctagc

SEQ ID NO: 1298 - DNA, 726 bp, Artificial Sequence
  Description of Artificial Sequence: Synthetic CD19 scFv sequence
gacatccagatgacacagaccacaagctccctgagcgcctccctgggcgacagagtgaccatctcttgccgggccagccaggatatctccaagtatctgaactggtaccagcagaagccagatggcacagtgaagctgctgatctatcacacctctcgcctgcacagcggagtgccctccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataattccgccctgaagtctcggctgacaatcatcaaggacaactctaagagccaggtgtttctgaagatgaatagcctgcagacagacgataccgccatctactattgcgccaagcactactattacggcggctcctatgccatggattactggggccagggcacatctgtgaccgtgtctagc

SEQ ID NO: 1299 - DNA, 726 bp, Artificial Sequence
  Description of Artificial Sequence: Synthetic CD19 scFv sequence
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgacaatcatcaaggacaactctaagagccaggtgtttctgaagatgaatagcctgcagacagacgataccgccatctactattgtgccaagcactactattacggcggcagctatgccatggattactggggccagggcacatccgtgaccgtgtctagc

SEQ ID NO: 1300 - protein, 69 aa, Homo sapiens; identical to SEQ ID NO: 607

SEQ ID NO: 1301 - DNA, 207 bp, Homo sapiens
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcactttactgccc

SEQ ID NO: 1302 - protein, 45 aa, Homo sapiens; identical to SEQ ID NO: 601

SEQ ID NO: 1303 - DNA, 135 bp, Artificial Sequence
  Description of Artificial Sequence: Synthetic construct
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgat

SEQ ID NO: 1304 - DNA, 135 bp, Artificial Sequence
  Description of Artificial Sequence: Synthetic construct
acaacaaccccagcacccagacctccaacacctgcaccaaccatcgcaagccagcctctgtccctgaggcccgaggcatgtaggccagcagcaggaggcgccgtgcacacccggggcctggactttgcctgcgat

SEQ ID NO: 1305 - DNA, 135 bp, Artificial Sequence
  Description of Artificial Sequence: Synthetic construct
accacaaccccagcaccccgcccaccaacacctgcaccaaccatcgcctcccagccactgtctctgaggcccgaggcatgtaggcctgcagcaggaggcgccgtgcacaccaggggcctggactttgcctgcgat

SEQ ID NO: 1306 - DNA, 135 bp, Artificial Sequence
  Description of Artificial Sequence: Synthetic construct
accacaaccccagcacccagaccaccaacacctgcaccaaccatcgcaagccagcctctgtccctgcgcccagaggcatgcaggccagcagcaggaggagcagtgcacacccggggcctggacttcgcatgtgat

SEQ ID NO: 1307 - DNA, 135 bp, Artificial Sequence
  Description of Artificial Sequence: Synthetic construct
accacaaccccagcacctcgcccaccaacaccagcaccaaccatcgcatcccagccactgtctctgcgccccgaggcatgcaggcctgcagcaggcggcgccgtgcacaccaggggcctggacttcgcctgtgat

SEQ ID NO: 1308 - protein, 112 aa, Homo sapiens; identical to SEQ ID NO: 419

SEQ ID NO: 1309 - DNA, 338 bp, Artificial Sequence
  Description of Artificial Sequence: Synthetic construct
agggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtg

SEQ ID NO: 1310 - DNA, 338 bp, Artificial Sequence
  Description of Artificial Sequence: Synthetic construct
agggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 1311 - DNA, 338 bp, Artificial Sequence
  Description of Artificial Sequence: Synthetic construct
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaaggtg

SEQ ID NO: 1312 - DNA, 338 bp, Artificial Sequence
  Description of Artificial Sequence: Synthetic construct
agggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 1313 - DNA, 338 bp, Artificial Sequence
  Description of Artificial Sequence: Synthetic construct
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaaggtg

SEQ ID NO: 1314 - protein, 42 aa, Homo sapiens; identical to SEQ ID NO: 426

SEQ ID NO: 1315 - DNA, 126 bp, Artificial Sequence
  Description of Artificial Sequence: Synthetic construct
aagagaggccggaagaagctgctgtacatcttcaagcagcccttcatgaggcccgtgcagacaacccaggaggaggacggctgcagctgtcggttcccagaggaggaggagggaggatgtgagctg

SEQ ID NO: 1316 - DNA, 126 bp, Artificial Sequence
  Description of Artificial Sequence: Synthetic construct
aagcgcggcaggaagaagctgctgtacatcttcaagcagccctttatgcgccctgtgcagacaacccaggaggaggacggctgcagctgtaggttcccagaggaggaggagggaggatgtgagctg

SEQ ID NO: 1317 - DNA, 126 bp, Artificial Sequence
  Description of Artificial Sequence: Synthetic construct
aagcgcggcaggaagaagctgctgtacatcttcaagcagccttttatgcgcccagtgcagacaacccaggaggaggacggctgcagctgtaggttccctgaggaggaggagggaggatgtgagctg

SEQ ID NO: 1318 - DNA, 126 bp, Artificial Sequence
  Description of Artificial Sequence: Synthetic construct
aagcgcggcaggaagaagctgctgtacatcttcaagcagccctttatgcgccctgtgcagacaacccaggaggaggacggctgcagctgtaggttccctgaggaggaggagggaggatgtgagctg

SEQ ID NO: 1319 - DNA, 126 bp, Artificial Sequence
  Description of Artificial Sequence: Synthetic construct
aagcgcggcaggaagaagctgctgtacatcttcaagcagccttttatgcgcccagtgcagacaacccaggaggaggacggctgcagctgtaggttccctgaggaggaggagggaggatgcgagctg

SEQ ID NO: 1320 - protein, 21 aa, Homo sapiens
MALPVTALLLPLALLLHAARP

SEQ ID NO: 1321 - DNA, 63 bp, Homo sapiens
atggccttaccagtgaccgccttgctcctgccgctggccttgctgctccacgccgccaggccg

SEQ ID NO: 1322 - DNA, 63 bp, Artificial Sequence
  Description of Artificial Sequence: Synthetic signal sequence
atggcactgcctgtgaccgccctgctgctgccactggccctgctgctgcacgcagccaggccc

SEQ ID NO: 1323 - DNA, 63 bp, Artificial Sequence
  Description of Artificial Sequence: Synthetic signal sequence
atggcactgccagtgacagccctgctgctgcctctggccctgctgctgcacgcagccagacct

SEQ ID NO: 1324 - DNA, 63 bp, Artificial Sequence
  Description of Artificial Sequence: Synthetic signal sequence
atggcactgcctgtgacagccctgctgctgccactggccctgctgctgcacgcagcccgccct

SEQ ID NO: 1325 - DNA, 63 bp, Artificial Sequence
  Description of Artificial Sequence: Synthetic signal sequence
atggcactgcctgtgaccgccctgctgctgccactggccctgctgctgcacgcagcccgccct

SEQ ID NO: 1326 - DNA, 63 bp, Artificial Sequence
  Description of Artificial Sequence: Synthetic signal sequence
atggcactgcctgtgaccgccctgctgctgccactggccctgctgctgcacgcagccaggcct

SEQ ID NO: 1327 - DNA, 63 bp, Artificial Sequence
  Description of Artificial Sequence: Synthetic signal sequence
atggcactgccagtgaccgccctgctgctgcctctggccctgctgctgcacgcagccagacca

SEQ ID NO: 1328 - DNA, 63 bp, Artificial Sequence
  Description of Artificial Sequence: Synthetic signal sequence
atggcactgcctgtgaccgccctgctgctgccactggccctgctgctgcacgcagccaggcca

SEQ ID NO: 1329 - protein, 5 aa, Artificial Sequence
  Description of Artificial Sequence: Synthetic linker
GGSGG

SEQ ID NO: 1330 - DNA, 15 bp, Artificial Sequence
  Description of Artificial Sequence: Synthetic linker
ggaggcagcggagga

SEQ ID NO: 1331 - DNA, 15 bp, Artificial Sequence
  Description of Artificial Sequence: Synthetic linker
ggaggctctggagga

SEQ ID NO: 1332 - DNA, 15 bp, Artificial Sequence
  Description of Artificial Sequence: Synthetic linker
ggaggctccggcgga

SEQ ID NO: 1333 - DNA, 15 bp, Artificial Sequence
  Description of Artificial Sequence: Synthetic linker
ggaggatccggaggc

SEQ ID NO: 1334 - DNA, 15 bp, Artificial Sequence
  Description of Artificial Sequence: Synthetic linker
ggaggatctggagga

SEQ ID NO: 1335 - DNA, 10 bp, Artificial Sequence
  Description of Artificial Sequence: Synthetic linker
  modified_base (7)..(10): a, c, t or g
agtggannnn

SEQ ID NO: 1336 - protein, 12 aa, Artificial Sequence
  Description of Artificial Sequence: Synthetic cleavage site
ESRRVRRNKRSK

SEQ ID NO: 1337 - DNA, 36 bp, Artificial Sequence
  Description of Artificial Sequence: Synthetic cleavage site
gagtctaggcgcgtgcggagaaataagcggagcaag

SEQ ID NO: 1338 - DNA, 36 bp, Artificial Sequence
  Description of Artificial Sequence: Synthetic cleavage site
gagtctcggagagtgaggcgcaataagaggagcaag

SEQ ID NO: 1339 - DNA, 36 bp, Artificial Sequence
  Description of Artificial Sequence: Synthetic cleavage site
gagtccaggagagtgcggcgcaacaagaggagcaag

SEQ ID NO: 1340 - protein, 677 aa, Artificial Sequence; identical to SEQ ID NO: 676
  Description of Artificial Sequence: Synthetic polypeptide

SEQ ID NO: 1341 - protein, 677 aa, Artificial Sequence; identical to SEQ ID NO: 677
  Description of Artificial Sequence: Synthetic polypeptide

SEQ ID NO: 1342 - protein, 677 aa, Artificial Sequence; identical to SEQ ID NO: 678
  Description of Artificial Sequence: Synthetic polypeptide

SEQ ID NO: 1343 - protein, 677 aa, Artificial Sequence; identical to SEQ ID NO: 679
  Description of Artificial Sequence: Synthetic polypeptide

SEQ ID NO: 1344 - protein, 686 aa, Artificial Sequence; identical to SEQ ID NO: 682
  Description of Artificial Sequence: Synthetic polypeptide

SEQ ID NO: 1345 - protein, 686 aa, Artificial Sequence; identical to SEQ ID NO: 683
  Description of Artificial Sequence: Synthetic polypeptide

SEQ ID NO: 1346 - protein, 107 aa, Homo sapiens
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 1347 - protein, 65 aa, Artificial Sequence
  Description of Artificial Sequence: Synthetic polypeptide
VMYPPPYLDNEKSNGTIIHVKGKHLCPSPLFPGPSKPFWVLVVVGGVLACYSLLVTVAFIIFWVR

SEQ ID NO: 1348 - protein, 69 aa, Artificial Sequence; identical to SEQ ID NO: 607
  Description of Artificial Sequence: Synthetic polypeptide

SEQ ID NO: 1349 - protein, 68 aa, Homo sapiens
TTPAPRPPTPAPTIASQPLSLRPEACRPAAGGAVHTRGLDFACDIYIWAPLAGTCGVLLLSLVITLYC

SEQ ID NO: 1350 - protein, 243 aa, Homo sapiens
DIQMTQSSSYLSVSLGGRVTITCKASDHINNWLAWYQQKPGNAPRLLISGATSLETGVPSRFSGSGSGKDYTLSITSLQTEDVATYYCQQYWSTPFTFGSGTKLEIKGGGGSGGGGSGGGGSQVQLKESGPGLVAPSQSLSITSTVSGFSLSRYSVHWVRQPPGKGLEWLGMIWGGGSTDYNSALKSRLSISKDNSKSQVFLKMNSLQTDDTAMYYCARNEGDTTAGTWFAYWGQGTLVTVSS

SEQ ID NO: 1351 - protein, 62 aa, Homo sapiens
ALSNSIMYFSHFVPVFLPAKPTTTPAPRPPTPAPTIASQPLSLRPEACRPAAGGAVHTRGLD

SEQ ID NO: 1352 - protein, 68 aa, Homo sapiens
TTTPAPRPPTPAPTIASQPLSLRPEACRPAAGGAVHTRGLDFACDIYIWAPLAGTCGVLLLSLVITLY

SEQ ID NO: 1353 - protein, 70 aa, Homo sapiens
KPTTTPAPRPPTPAPTIASQPLSLRPEACRPAAGGAVHTRGLDFACDIYIWAPLAGTCGVLLLSLVITLY

SEQ ID NO: 1354 - protein, 680 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1355 - protein, 680 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFLGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1356 - protein, 680 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1357 - protein, 580 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1358 - protein, 711 aa, Artificial Sequence
  Description of Artificial Sequence: Synthetic chimeric antigen receptor
MLLLVTSLLLLCELPHPAFLLIPDIQMTQQTTSSLSASLGDRVTISCRASSQDISKYLNWYQQKPDGTVKLLLIYHTSRLHSGVPSRFSGSGGSGTDYSLTISNLEQEDIATYYFCQQGNTLPYTFGGGTKLEIITGSTSGSGKPGSGEGSTKGEEVKLQESGPGLVAPSQSLSVTTCTVSGVSLPDYGVSWIRQPPPRKGLEWLGVIWGSETTYYNSSALKSRLTIIKDNSKSQVFLKKMNSLQTDDTAIYYCAKHYYYYGGSYAMDYWGQGTSVTVSSEESKYGPPCPPCPAPEFLGGPSSVFLFPPKPKDTLMISRTPEVVTCVVVDVSQEDPEVQFNWYVVDGVEVHNAKTKPREEQFNSTTYRVVSVLTVLHQDWLNGKEYYKCKVSNKGLPSSIEKTISKAAKGQPREPQVYTLPPSQEEMTTKNQVSLTCLVKGFYPSDIAVVEWESNGQPENNYKTTPPVLDDSDGSFFLYSRLTVDKSRWQEEGNVFSCSVMHEALHNHYTQKKSLSLSLGKMFWVLVVVGGVLLACYSLLVTVAFIIFWVRSKRRSRGGHSDYMNMTPRRPGPTRRKHYQPYAPPRDFAAYRSRVKKFSRSADAPAYQQGQNQLYNEELNLGRREEYDVLDKRRGRDPPEMGGKPRRKNPQEGLYNELQQKDKMAEAYSEIGMKGERRRGGKGHDGLYQGLSTATKDTYDAALHMQALPPR

SEQ ID NO: 1359 - protein, 495 aa, Artificial Sequence
  Description of Artificial Sequence: Synthetic chimeric antigen receptor
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRADTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1360 - protein, 495 aa, Artificial Sequence; identical to SEQ ID NO: 307
  Description of Artificial Sequence: Synthetic chimeric antigen receptor

SEQ ID NO: 1361 - protein, 484 aa, Artificial Sequence
  Description of Artificial Sequence: Synthetic chimeric antigen receptor
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDMWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1362 - protein, 476 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCG

SEQ ID NO: 1363 - protein, 248 aa, Artificial Sequence
  Description of Artificial Sequence: Synthetic chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVS

SEQ ID NO: 1364 - protein, 254 aa, Artificial Sequence
  Description of Artificial Sequence: Synthetic chimeric antigen receptor
RCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSM

SEQ ID NO: 1365 - protein, 489 aa, Artificial Sequence
  Description of Artificial Sequence: Synthetic chimeric antigen receptor
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRTTTPAPRPPTPAPTIASQPLSLRPEACRPAAGGAVHTRGLDFACDIYIWAPLAGTCGVLLLSLVITLYCAVSLSKMLKKRSPLTTGVYVKMPPTEPECEKQFQPYFIPINSARVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1366 - protein, 522 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKIRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1367 - protein, 508 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKIRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 1368 - protein, 528 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCQRRKYRSNKGESPVEPAEPCHYSCPREEEGSTIPIQEDYRKPEPACSPRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1369 - protein, 514 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCQRRKYRSNKGESPVEPAEPCHYSCPREEEGSTIPIQEDYRKPEPACSPRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 1370 - protein, 522 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1371 - protein, 508 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 1372 - protein, 495 aa, Artificial Sequence; identical to SEQ ID NO: 307
  Description of Artificial Sequence: Synthetic chimeric antigen receptor

SEQ ID NO: 1373 - protein, 495 aa, Artificial Sequence; identical to SEQ ID NO: 307
  Description of Artificial Sequence: Synthetic chimeric antigen receptor

SEQ ID NO: 1374 - protein, 495 aa, Artificial Sequence; identical to SEQ ID NO: 307
  Description of Artificial Sequence: Synthetic chimeric antigen receptor

SEQ ID NO: 1375 - protein, 495 aa, Artificial Sequence; identical to SEQ ID NO: 307
  Description of Artificial Sequence: Synthetic chimeric antigen receptor

SEQ ID NO: 1376 - protein, 495 aa, Artificial Sequence; identical to SEQ ID NO: 307
  Description of Artificial Sequence: Synthetic chimeric antigen receptor

SEQ ID NO: 1377 - protein, 495 aa, Artificial Sequence; identical to SEQ ID NO: 307
  Description of Artificial Sequence: Synthetic chimeric antigen receptor

SEQ ID NO: 1378 - protein, 495 aa, Artificial Sequence; identical to SEQ ID NO: 307
  Description of Artificial Sequence: Synthetic chimeric antigen receptor

SEQ ID NO: 1379 - protein, 495 aa, Artificial Sequence; identical to SEQ ID NO: 307
  Description of Artificial Sequence: Synthetic chimeric antigen receptor

SEQ ID NO: 1380 - protein, 251 aa, Artificial Sequence; identical to SEQ ID NO: 386
  Description of Artificial Sequence: Synthetic chimeric antigen receptor

SEQ ID NO: 1381 - protein, 495 aa, Artificial Sequence; identical to SEQ ID NO: 307
  Description of Artificial Sequence: Synthetic chimeric antigen receptor

SEQ ID NO: 1382 - protein, 495 aa, Artificial Sequence; identical to SEQ ID NO: 307
  Description of Artificial Sequence: Synthetic chimeric antigen receptor

SEQ ID NO: 1383 - protein, 495 aa, Artificial Sequence; identical to SEQ ID NO: 307
  Description of Artificial Sequence: Synthetic chimeric antigen receptor

SEQ ID NO: 1384 - protein, 495 aa, Artificial Sequence; identical to SEQ ID NO: 1359
  Description of Artificial Sequence: Synthetic chimeric antigen receptor

SEQ ID NO: 1385 - protein, 495 aa, Artificial Sequence; identical to SEQ ID NO: 307
  Description of Artificial Sequence: Synthetic chimeric antigen receptor

SEQ ID NO: 1386 - protein, 495 aa, Artificial Sequence; identical to SEQ ID NO: 1359
  Description of Artificial Sequence: Synthetic chimeric antigen receptor

SEQ ID NO: 1387 - protein, 495 aa, Artificial Sequence; identical to SEQ ID NO: 307
  Description of Artificial Sequence: Synthetic chimeric antigen receptor

SEQ ID NO: 1388 - protein, 495 aa, Artificial Sequence; identical to SEQ ID NO: 1359
  Description of Artificial Sequence: Synthetic chimeric antigen receptor

SEQ ID NO: 1389 - protein, 495 aa, Artificial Sequence; identical to SEQ ID NO: 307
  Description of Artificial Sequence: Synthetic chimeric antigen receptor

SEQ ID NO: 1390 - protein, 494 aa, Artificial Sequence
  Description of Artificial Sequence: Synthetic chimeric antigen receptor
METDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1391 - protein, 494 aa, Artificial Sequence; identical to SEQ ID NO: 1390
  Description of Artificial Sequence: Synthetic chimeric antigen receptor

SEQ ID NO: 1392 - protein, 144 aa, Artificial Sequence
  Description of Artificial Sequence: Synthetic chimeric antigen receptor
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSE

SEQ ID NO: 1393 - protein, 486 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1394 - protein, 486 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1395 - protein, 486 aa, Artificial Sequence
  Description of Artificial Sequence: Synthetic chimeric antigen receptor
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1396 - protein, 486 aa, Artificial Sequence
  Description of Artificial Sequence: Synthetic chimeric antigen receptor
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1397 - protein, 491 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1398 - protein, 491 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1399 - protein, 491 aa, Artificial Sequence
  Description of Artificial Sequence: Synthetic chimeric antigen receptor
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1400 - protein, 491 aa, Artificial Sequence
  Description of Artificial Sequence: Synthetic chimeric antigen receptor
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1401 - protein, 491 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1402 - protein, 491 aa, Artificial Sequence; identical to SEQ ID NO: 1401
  Description of Artificial Sequence: Synthetic chimeric antigen receptor

SEQ ID NO: 1403 - protein, 491 aa, Artificial Sequence
  Description of Artificial Sequence: Synthetic chimeric antigen receptor
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1404 - protein, 486 aa, Artificial Sequence
  Description of Artificial Sequence: Synthetic chimeric antigen receptor
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1405 - protein, 486 aa, Artificial Sequence; identical to SEQ ID NO: 669
  Description of Artificial Sequence: Synthetic chimeric antigen receptor

SEQ ID NO: 1406 - protein, 495 aa, Artificial Sequence; identical to SEQ ID NO: 1359
  Description of Artificial Sequence: Synthetic chimeric antigen receptor

SEQ ID NO: 1407 - protein, 495 aa, Artificial Sequence; identical to SEQ ID NO: 307
  Description of Artificial Sequence: Synthetic chimeric antigen receptor

SEQ ID NO: 1408 - protein, 530 aa, Artificial Sequence
  Description of Artificial Sequence: Synthetic chimeric antigen receptor
MALPVTALLLPLALLLHAARPDIMMTQSPSSLAVSAGEKVTMTCKSSQSVLYSSNQKNYLAWYQQKPGQSPKLLIYWASTRESGVPDRFTGSGSGTDFTLTISSVQPEDLAVYYCHQYLSSHTFGGGTKLEIKRGGGGSGGGGSGGGGSQLQQPGAELVRPGSSVKLSCKASGYTFTRYWIHWVKQRPIQGLEWIGNIDPSDSETHYNQKFKDKATLTVDKSSGTAYMQLSSLTSEDSAVYYCATEDLYYAMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 1409 - protein, 486 aa, Artificial Sequence; identical to SEQ ID NO: 1394
  Description of Artificial Sequence: Synthetic chimeric antigen receptor

SEQ ID NO: 1410 - protein, 486 aa, Artificial Sequence; identical to SEQ ID NO: 1395
  Description of Artificial Sequence: Synthetic chimeric antigen receptor

SEQ ID NO: 1411 - protein, 486 aa, Artificial Sequence; identical to SEQ ID NO: 1396
  Description of Artificial Sequence: Synthetic chimeric antigen receptor

SEQ ID NO: 1412 - protein, 491 aa, Artificial Sequence; identical to SEQ ID NO: 1397
  Description of Artificial Sequence: Synthetic chimeric antigen receptor

SEQ ID NO: 1413 - protein, 491 aa, Artificial Sequence; identical to SEQ ID NO: 1398
  Description of Artificial Sequence: Synthetic chimeric antigen receptor

SEQ ID NO: 1414 - protein, 491 aa, Artificial Sequence; identical to SEQ ID NO: 1399
  Description of Artificial Sequence: Synthetic chimeric antigen receptor

SEQ ID NO: 1415 - protein, 491 aa, Artificial Sequence; identical to SEQ ID NO: 1400
  Description of Artificial Sequence: Synthetic chimeric antigen receptor

SEQ ID NO: 1416 - protein, 491 aa, Artificial Sequence; identical to SEQ ID NO: 1401
  Description of Artificial Sequence: Synthetic chimeric antigen receptor

SEQ ID NO: 1417 - protein, 491 aa, Artificial Sequence; identical to SEQ ID NO: 1401
  Description of Artificial Sequence: Synthetic chimeric antigen receptor

SEQ ID NO: 1418 - protein, 491 aa, Artificial Sequence; identical to SEQ ID NO: 1403
  Description of Artificial Sequence: Synthetic chimeric antigen receptor

SEQ ID NO: 1419 - protein, 486 aa, Artificial Sequence; identical to SEQ ID NO: 1404
  Description of Artificial Sequence: Synthetic chimeric antigen receptor

SEQ ID NO: 1420 - protein, 465 aa, Artificial Sequence
  Description of Artificial Sequence: Synthetic chimeric antigen receptor
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1421 - protein, 681 aa, Artificial Sequence
  Description of Artificial Sequence: Synthetic chimeric antigen receptor
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1422 - protein, 838 aa, Artificial Sequence
  Description of Artificial Sequence: Synthetic chimeric antigen receptor
MLLLVTSLLLCELPHPAFLLIPQSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYGDFNIWGPGTLVTISSGGGGSGGGGSGGGGSELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVKESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1423 - protein, 1055 aa, Artificial Sequence [sequence omitted]

SEQ ID NO: 1424 - protein, 945 aa, Artificial Sequence
  Description of Artificial Sequence: Synthetic chimeric antigen receptor
MLLLVTSLLLCELPHPAFLLIPQSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYGDFNIWGPGTLVTISSGGGGSGGGGSGGGGSELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVKESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1425 - protein, 845 aa, Artificial Sequence
  Description of Artificial Sequence: Synthetic chimeric antigen receptor
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1426 - protein, 952 aa, Artificial Sequence
  Description of Artificial Sequence: Synthetic chimeric antigen receptor
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1427 - protein, 1062 aa, Artificial Sequence
  Description of Artificial Sequence: Synthetic chimeric antigen receptor
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1428 - protein, 502 aa, Artificial Sequence
  Description of Artificial Sequence: Synthetic chimeric antigen receptor
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1429 - protein, 508 aa, Artificial Sequence
  Description of Artificial Sequence: Synthetic chimeric antigen receptor
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1430 - protein, 509 aa, Artificial Sequence
  Description of Artificial Sequence: Synthetic chimeric antigen receptor
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1431 - protein, 550 aa, Artificial Sequence
  Description of Artificial Sequence: Synthetic chimeric antigen receptor
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1432 - protein, 556 aa, Artificial Sequence
  Description of Artificial Sequence: Synthetic chimeric antigen receptor
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1433 - protein, 506 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1434 - protein, 560 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1435 - protein, 513 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1436 - protein, 554 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1437 - protein, 476 aa, Artificial Sequence
  Description of Artificial Sequence: Synthetic chimeric antigen receptor
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPQVRKAAITSYEKSDGVYTGLSTRNQETYETLKHEKPPQ

SEQ ID NO: 1438 - protein, 480 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPQVRKAAITSYEKSDGVYTGLSTRNQETYETLKHEKPPQ

SEQ ID NO: 1439 - protein, 428 aa, Artificial Sequence
  Description of Artificial Sequence: Synthetic chimeric antigen receptor
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQVRKAAITSYEKSDGVYTGLSTRNQETYETLKHEKPPQ

SEQ ID NO: 1440 - protein, 432 aa, Artificial Sequence
  Description of Artificial Sequence: Synthetic chimeric antigen receptor
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQVRKAAITSYEKSDGVYTGLSTRNQETYETLKHEKPPQ

SEQ ID NO: 1441 - protein, 486 aa, Artificial Sequence; identical to SEQ ID NO: 1393
  Description of Artificial Sequence: Synthetic chimeric antigen receptor

SEQ ID NO: 1442 - protein, 486 aa, Artificial Sequence; identical to SEQ ID NO: 1394
  Description of Artificial Sequence: Synthetic chimeric antigen receptor

SEQ ID NO: 1443 - protein, 486 aa, Artificial Sequence; identical to SEQ ID NO: 1395
  Description of Artificial Sequence: Synthetic chimeric antigen receptor

SEQ ID NO: 1444 - protein, 486 aa, Artificial Sequence; identical to SEQ ID NO: 1396
  Description of Artificial Sequence: Synthetic chimeric antigen receptor

SEQ ID NO: 1445 - protein, 491 aa, Artificial Sequence; identical to SEQ ID NO: 1397
  Description of Artificial Sequence: Synthetic chimeric antigen receptor

SEQ ID NO: 1446 - protein, 491 aa, Artificial Sequence; identical to SEQ ID NO: 1398
  Description of Artificial Sequence: Synthetic chimeric antigen receptor

SEQ ID NO: 1447 - protein, 491 aa, Artificial Sequence; identical to SEQ ID NO: 1399
  Description of Artificial Sequence: Synthetic chimeric antigen receptor

SEQ ID NO: 1448 - protein, 491 aa, Artificial Sequence; identical to SEQ ID NO: 1400
  Description of Artificial Sequence: Synthetic chimeric antigen receptor

SEQ ID NO: 1449 - protein, 491 aa, Artificial Sequence; identical to SEQ ID NO: 1401
  Description of Artificial Sequence: Synthetic chimeric antigen receptor

SEQ ID NO: 1450 - protein, 491 aa, Artificial Sequence; identical to SEQ ID NO: 1401
  Description of Artificial Sequence: Synthetic chimeric antigen receptor

SEQ ID NO: 1451 - protein, 491 aa, Artificial Sequence; identical to SEQ ID NO: 1403
  Description of Artificial Sequence: Synthetic chimeric antigen receptor

SEQ ID NO: 1452 - protein, 486 aa, Artificial Sequence; identical to SEQ ID NO: 1404
  Description of Artificial Sequence: Synthetic chimeric antigen receptor

SEQ ID NO: 1453 - protein, 486 aa, Artificial Sequence; identical to SEQ ID NO: 669
  Description of Artificial Sequence: Synthetic chimeric antigen receptor

SEQ ID NO: 1454 - protein, 486 aa, Artificial Sequence; identical to SEQ ID NO: 1393
  Description of Artificial Sequence: Synthetic chimeric antigen receptor

SEQ ID NO: 1455 - protein, 486 aa, Artificial Sequence; identical to SEQ ID NO: 1394
  Description of Artificial Sequence: Synthetic chimeric antigen receptor

SEQ ID NO: 1456 - protein, 486 aa, Artificial Sequence; identical to SEQ ID NO: 1395
  Description of Artificial Sequence: Synthetic chimeric antigen receptor

SEQ ID NO: 1457 - protein, 486 aa, Artificial Sequence; identical to SEQ ID NO: 1396
  Description of Artificial Sequence: Synthetic chimeric antigen receptor

SEQ ID NO: 1458 - protein, 491 aa, Artificial Sequence; identical to SEQ ID NO: 1397
  Description of Artificial Sequence: Synthetic chimeric antigen receptor

SEQ ID NO: 1459 - protein, 491 aa, Artificial Sequence; identical to SEQ ID NO: 1398
  Description of Artificial Sequence: Synthetic chimeric antigen receptor

SEQ ID NO: 1460 - protein, 491 aa, Artificial Sequence; identical to SEQ ID NO: 1399
  Description of Artificial Sequence: Synthetic chimeric antigen receptor

SEQ ID NO: 1461 - protein, 491 aa, Artificial Sequence; identical to SEQ ID NO: 1400
  Description of Artificial Sequence: Synthetic chimeric antigen receptor

SEQ ID NO: 1462 - protein, 491 aa, Artificial Sequence; identical to SEQ ID NO: 1401
  Description of Artificial Sequence: Synthetic chimeric antigen receptor

SEQ ID NO: 1463 - protein, 491 aa, Artificial Sequence; identical to SEQ ID NO: 1401
  Description of Artificial Sequence: Synthetic chimeric antigen receptor

SEQ ID NO: 1464 - protein, 491 aa, Artificial Sequence; identical to SEQ ID NO: 1403
  Description of Artificial Sequence: Synthetic chimeric antigen receptor

SEQ ID NO: 1465 - protein, 486 aa, Artificial Sequence; identical to SEQ ID NO: 1404
  Description of Artificial Sequence: Synthetic chimeric antigen receptor

SEQ ID NO: 1466 - protein, 527 aa, Artificial Sequence
  Description of Artificial Sequence: Synthetic chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVRWGSETTYYNSALKSRLTIIKDNSKSQVFLKMNSLQTDDTAIYYCAKHYYYGGSYAMDYWGQGTSVTVSSAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSASGGGGSGGGGSKSRQTPPLASVEMEAMEALPVTWGTSSRDEDLENCSHHLGGGGSGGGGSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1467 - protein, 527 aa, Artificial Sequence
  Description of Artificial Sequence: Synthetic chimeric antigen receptor
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1468 - protein, 222 aa, Artificial Sequence; identical to SEQ ID NO: 454
  Description of Artificial Sequence: Synthetic Chimeric Antigen Receptor

SEQ ID NO: 1469 - protein, 226 aa, Artificial Sequence; identical to SEQ ID NO: 559
  Description of Artificial Sequence: Synthetic Chimeric Antigen Receptor

SEQ ID NO: 1470 - protein, 286 aa, Artificial Sequence; identical to SEQ ID NO: 558
  Description of Artificial Sequence: Synthetic Chimeric Antigen Receptor

SEQ ID NO: 1471 - protein, 726 aa, Artificial Sequence
  Description of Artificial Sequence: Synthetic Chimeric Antigen Receptor
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1472 - protein, 490 aa, Artificial Sequence
  Description of Artificial Sequence: Synthetic Chimeric Antigen Receptor
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1473 - protein, 730 aa, Artificial Sequence
  Description of Artificial Sequence: Synthetic Chimeric Antigen Receptor
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1474 - protein, 494 aa, Artificial Sequence
  Description of Artificial Sequence: Synthetic Chimeric Antigen Receptor
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1475 - protein, 790 aa, Artificial Sequence
  Description of Artificial Sequence: Synthetic Chimeric Antigen Receptor
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1476 - protein, 554 aa, Artificial Sequence
  Description of Artificial Sequence: Synthetic Chimeric Antigen Receptor
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1477 - protein, 728 aa, Artificial Sequence
  Description of Artificial Sequence: Synthetic Chimeric Antigen Receptor
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1478 - protein, 491 aa, Artificial Sequence
  Description of Artificial Sequence: Synthetic Chimeric Antigen Receptor
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1479 - protein, 732 aa, Artificial Sequence
  Description of Artificial Sequence: Synthetic Chimeric Antigen Receptor
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1480 - protein, 495 aa, Artificial Sequence
  Description of Artificial Sequence: Synthetic Chimeric Antigen Receptor
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1481 - protein, 792 aa, Artificial Sequence
  Description of Artificial Sequence: Synthetic Chimeric Antigen Receptor
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1482 - protein, 555 aa, Artificial Sequence
  Description of Artificial Sequence: Synthetic Chimeric Antigen Receptor
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1483 - protein, 725 aa, Artificial Sequence
  Description of Artificial Sequence: Synthetic Chimeric Antigen Receptor
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1484 - protein, 489 aa, Artificial Sequence
  Description of Artificial Sequence: Synthetic Chimeric Antigen Receptor
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1485 - protein, 729 aa, Artificial Sequence
  Description of Artificial Sequence: Synthetic Chimeric Antigen Receptor
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1486 - protein, 493 aa, Artificial Sequence
  Description of Artificial Sequence: Synthetic Chimeric Antigen Receptor
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1487 - protein, 789 aa, Artificial Sequence [sequence omitted]

SEQ ID NO: 1488 - protein, 553 aa, Artificial Sequence
  Description of Artificial Sequence: Synthetic Chimeric Antigen Receptor
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1489 - protein, 724 aa, Artificial Sequence
  Description of Artificial Sequence: Synthetic Chimeric Antigen Receptor
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1490 - protein, 487 aa, Artificial Sequence
  Description of Artificial Sequence: Synthetic Chimeric Antigen Receptor
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1491 - protein, 728 aa, Artificial Sequence
  Description of Artificial Sequence: Synthetic Chimeric Antigen Receptor
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1492 - protein, 491 aa, Artificial Sequence
  Description of Artificial Sequence: Synthetic Chimeric Antigen Receptor
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1493 - protein, 788 aa, Artificial Sequence
  Description of Artificial Sequence: Synthetic Chimeric Antigen Receptor
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1494 - protein, 551 aa, Artificial Sequence
  Description of Artificial Sequence: Synthetic Chimeric Antigen Receptor
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1495 - protein, 728 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1496 - protein, 492 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1497 - protein, 732 aa, Artificial Sequence [sequence omitted]

SEQ ID NO: 1498 - protein, 496 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1499 - protein, 792 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1500 - protein, 556 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1501 - protein, 728 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1502 - protein, 491 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1503 - protein, 732 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1504 - protein, 495 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1505 - protein, 792 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1506 - protein, 555 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1507 - protein, 726 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1508 - protein, 490 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1509 - protein, 730 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1510 - protein, 494 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1511 - protein, 790 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1512 - protein, 554 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1513 - protein, 724 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1514 - protein, 487 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1515 - protein, 728 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1516 - protein, 491 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1517 - protein, 788 aa, Artificial Sequence [sequence omitted]

SEQ ID NO: 1518 - protein, 551 aa, Artificial Sequence
  Description of Artificial Sequence: Synthetic Chimeric Antigen Receptor
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1519 - protein, 484 aa, Artificial Sequence
  Description of Artificial Sequence: Synthetic Chimeric Antigen Receptor
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1520 - protein, 480 aa, Artificial Sequence
  Description of Artificial Sequence: Synthetic Chimeric Antigen Receptor
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1521 - protein, 544 aa, Artificial Sequence
  Description of Artificial Sequence: Synthetic Chimeric Antigen Receptor
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1522 - protein, 727 aa, Artificial Sequence
  Description of Artificial Sequence: Synthetic Chimeric Antigen Receptor
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1523 - protein, 792 aa, Artificial Sequence
  Description of Artificial Sequence: Synthetic Chimeric Antigen Receptor
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1524 - protein, 506 aa, Artificial Sequence
  Description of Artificial Sequence: Synthetic Chimeric Antigen Receptor
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1525 - protein, 571 aa, Artificial Sequence
  Description of Artificial Sequence: Synthetic Chimeric Antigen Receptor
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1526 - protein, 727 aa, Artificial Sequence
  Description of Artificial Sequence: Synthetic Chimeric Antigen Receptor
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1527 - protein, 792 aa, Artificial Sequence [sequence omitted]

SEQ ID NO: 1528 - protein, 511 aa, Artificial Sequence
  Description of Artificial Sequence: Synthetic Chimeric Antigen Receptor
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1529 - protein, 703 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1530 - protein, 714 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEGAAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1531 - protein, 701 aa, Artificial Sequence
  Description of Artificial Sequence: Synthetic Chimeric Antigen Receptor
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1532 - protein, 466 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1533 - protein, 470 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1534 - protein, 530 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1535 - protein, 470 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1536 - protein, 474 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1537 - protein, 534 aa, Artificial Sequence
  Description of Artificial Sequence: Synthetic Chimeric Antigen Receptor
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1538 - protein, 464 aa, Artificial Sequence
  Description of Artificial Sequence: Synthetic Chimeric Antigen Receptor
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1539 - protein, 468 aa, Artificial Sequence
  Description of Artificial Sequence: Synthetic Chimeric Antigen Receptor
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1540 - protein, 528 aa, Artificial Sequence
  Description of Artificial Sequence: Synthetic Chimeric Antigen Receptor
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1541 - protein, 223 aa, Artificial Sequence
  Description of Artificial Sequence: Synthetic Chimeric Antigen Receptor
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1542 - protein, 496 aa, Artificial Sequence
  Description of Artificial Sequence: Synthetic Chimeric Antigen Receptor
MVATLLVTSLLLCELPHPAFLLIPDTEVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1543 - DNA, 726 bp, Artificial Sequence; identical to SEQ ID NO: 1295
  Description of Artificial Sequence: Synthetic CD19 scFv sequence

SEQ ID NO: 1544 - DNA, 726 bp, Artificial Sequence; identical to SEQ ID NO: 1296
  Description of Artificial Sequence: Synthetic CD19 scFv sequence

SEQ ID NO: 1545 - DNA, 726 bp, Artificial Sequence; identical to SEQ ID NO: 1297
  Description of Artificial Sequence: Synthetic CD19 scFv sequence

SEQ ID NO: 1546 - DNA, 726 bp, Artificial Sequence; identical to SEQ ID NO: 1298
  Description of Artificial Sequence: Synthetic CD19 scFv sequence

SEQ ID NO: 1547 - DNA, 726 bp, Artificial Sequence; identical to SEQ ID NO: 1299
  Description of Artificial Sequence: Synthetic CD19 scFv sequence

SEQ ID NO: 1548 - protein, 69 aa, Homo sapiens; identical to SEQ ID NO: 607

SEQ ID NO: 1549 - DNA, 207 bp, Artificial Sequence
  Description of Artificial Sequence: Synthetic construct
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgc

SEQ ID NO: 1550 - DNA, 207 bp, Homo sapiens; identical to SEQ ID NO: 1301

SEQ ID NO: 1551 - DNA, 207 bp, Artificial Sequence
  Description of Artificial Sequence: Synthetic construct
acaacaaccccagcacccagacctccaacacctgcaccaaccatcgcaagccagcctctgtccctgaggcccgaggcatgtaggccagcagcaggaggcgccgtgcacacccggggcctggactttgcctgcgatatctatatctgggcaccactggcaggaacatgtggcgtgctgctgctgtccctggtcatcaccctgtattgc

SEQ ID NO: 1552 - DNA, 207 bp, Artificial Sequence
  Description of Artificial Sequence: Synthetic construct
accacaaccccagcaccccgcccaccaacacctgcaccaaccatcgcctcccagccactgtctctgaggcccgaggcatgtaggcctgcagcaggaggcgccgtgcacaccaggggcctggactttgcctgcgatatctacatctgggcacctctggcaggaacatgtggcgtgctgctgctgtccctggtcatcaccctgtattgc

SEQ ID NO: 1553 - DNA, 207 bp, Artificial Sequence
  Description of Artificial Sequence: Synthetic construct
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgc

SEQ ID NO: 1554 - DNA, 135 bp, Artificial Sequence; identical to SEQ ID NO: 1303
  Description of Artificial Sequence: Synthetic construct

SEQ ID NO: 1555 - DNA, 135 bp, Artificial Sequence; identical to SEQ ID NO: 1304
  Description of Artificial Sequence: Synthetic construct

SEQ ID NO: 1556 - DNA, 135 bp, Artificial Sequence; identical to SEQ ID NO: 1305
  Description of Artificial Sequence: Synthetic construct

SEQ ID NO: 1557 - DNA, 135 bp, Artificial Sequence; identical to SEQ ID NO: 1306
  Description of Artificial Sequence: Synthetic construct

SEQ ID NO: 1558 - DNA, 135 bp, Artificial Sequence; identical to SEQ ID NO: 1307
  Description of Artificial Sequence: Synthetic construct

SEQ ID NO: 1559 - DNA, 336 bp, Artificial Sequence
  Description of Artificial Sequence: Synthetic construct
agggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaagg

SEQ ID NO: 1560 - DNA, 336 bp, Artificial Sequence
  Description of Artificial Sequence: Synthetic construct
agggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctagg

SEQ ID NO: 1561 - DNA, 336 bp, Artificial Sequence
  Description of Artificial Sequence: Synthetic construct
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaagg

SEQ ID NO: 1562 - DNA, 336 bp, Artificial Sequence
  Description of Artificial Sequence: Synthetic construct
agggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctagg

SEQ ID NO: 1563 - DNA, 336 bp, Artificial Sequence
  Description of Artificial Sequence: Synthetic construct
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaagg

SEQ ID NO: 1564 - DNA, 336 bp, Artificial Sequence
  Description of Artificial Sequence: Synthetic construct
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1565 - DNA, 126 bp, Artificial Sequence; identical to SEQ ID NO: 1315
  Description of Artificial Sequence: Synthetic construct

SEQ ID NO: 1566 - DNA, 126 bp, Artificial Sequence; identical to SEQ ID NO: 1316
  Description of Artificial Sequence: Synthetic construct

SEQ ID NO: 1567 - DNA, 126 bp, Artificial Sequence; identical to SEQ ID NO: 1317
  Description of Artificial Sequence: Synthetic construct

SEQ ID NO: 1568 - DNA, 126 bp, Artificial Sequence; identical to SEQ ID NO: 1318
  Description of Artificial Sequence: Synthetic construct

SEQ ID NO: 1569 - DNA, 126 bp, Artificial Sequence; identical to SEQ ID NO: 1319
  Description of Artificial Sequence: Synthetic construct

SEQ ID NO: 1570 - DNA, 126 bp, Artificial Sequence
  Description of Artificial Sequence: Synthetic construct
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 1571 - DNA, 72 bp, Artificial Sequence
  Description of Artificial Sequence: Synthetic construct
atctacatctgggcaccactggcaggaacatgcggcgtgctgctgctgtccctggtcatcaccctgtattgt

SEQ ID NO: 1572 - DNA, 72 bp, Artificial Sequence
  Description of Artificial Sequence: Synthetic construct
atctacatctgggcacctctggcaggaacatgcggcgtgctgctgctgtctctggtcatcaccctgtattgt

SEQ ID NO: 1573 - protein, 21 aa, Homo sapiens
MALPVTALLLPLALLLHAARP

SEQ ID NO: 1574 - DNA, 63 bp, Homo sapiens; identical to SEQ ID NO: 1321

SEQ ID NO: 1575 - DNA, 63 bp, Artificial Sequence; identical to SEQ ID NO: 1322
  Description of Artificial Sequence: Synthetic signal sequence

SEQ ID NO: 1576 - DNA, 63 bp, Artificial Sequence; identical to SEQ ID NO: 1323
  Description of Artificial Sequence: Synthetic signal sequence

SEQ ID NO: 1577 - DNA, 63 bp, Artificial Sequence; identical to SEQ ID NO: 1324
  Description of Artificial Sequence: Synthetic signal sequence

SEQ ID NO: 1578 - DNA, 63 bp, Artificial Sequence; identical to SEQ ID NO: 1325
  Description of Artificial Sequence: Synthetic signal sequence

SEQ ID NO: 1579 - protein, 22 aa, Homo sapiens
MCHQQLVISWFSLVFLASPLVA

SEQ ID NO: 1580 - DNA, 66 bp, Homo sapiens
atgtgtcaccagcagttggtcatctcttggttttccctggtttttctggcatctcccctcgtggcc

SEQ ID NO: 1581 - DNA, 66 bp, Artificial Sequence
  Description of Artificial Sequence: Synthetic signal sequence
atgtgccaccagcagctggtcatcagctggttctccctggtgtttctggcatcccctctggtggca

SEQ ID NO: 1582 - DNA, 66 bp, Artificial Sequence
  Description of Artificial Sequence: Synthetic signal sequence
atgtgccaccagcagctggtcatcagctggttctccctggtgtttctggccagccctctggtggcc

SEQ ID NO: 1583 - DNA, 66 bp, Artificial Sequence
  Description of Artificial Sequence: Synthetic signal sequence
atgtgccaccagcagctggtcatcagctggttctccctggtgtttctggcaagccctctggtggca

SEQ ID NO: 1584 - DNA, 66 bp, Artificial Sequence
  Description of Artificial Sequence: Synthetic signal sequence
atgtgccaccagcagctggtcatcagctggttctccctggtgtttctggcatccccactggtggca

SEQ ID NO: 1585 - DNA, 66 bp, Artificial Sequence
  Description of Artificial Sequence: Synthetic signal sequence
atgtgccaccaacagctcgtgatcagctggttctccctggtgttcctggctagccccctggtggcc

SEQ ID NO: 1586 - DNA, 66 bp, Artificial Sequence
  Description of Artificial Sequence: Synthetic signal sequence
atgtgccaccagcagctggtcatctcttggttcagcctggtgtttctggcctcccccctggtggcc

SEQ ID NO: 1587 - DNA, 66 bp, Artificial Sequence
  Description of Artificial Sequence: Synthetic signal sequence
atgtgccaccagcagctggtcatctcctggttctctctggtgtttctggcatctcctctggtggca

SEQ ID NO: 1588 - DNA, 66 bp, Artificial Sequence
  Description of Artificial Sequence: Synthetic signal sequence
atgtgccaccagcagctggtcatctcttggttcagcctggtgtttctggcatccccactggtggca

SEQ ID NO: 1589 - protein, 306 aa, Artificial Sequence; identical to SEQ ID NO: 734
  Description of Artificial Sequence: Synthetic payload sequence

SEQ ID NO: 1590 - DNA, 918 bp, Artificial Sequence
  Description of Artificial Sequence: Synthetic payload sequence
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtctagccggggctcctctgacccacagggagtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagtccaagcgggagaagaaggacagagtgttcaccgataagacatctgccaccgtgatctgtcggaagaacgcctccatctctgtgagggcccaggatcgctactattctagctcctggagcgagtgggcatccgtgccatgttct

SEQ ID NO: 1591 - DNA, 918 bp, Artificial Sequence
  Description of Artificial Sequence: Synthetic payload sequence
atctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagc

SEQ ID NO: 1592 - DNA, 918 bp, Artificial Sequence; identical to SEQ ID NO: 1591
  Description of Artificial Sequence: Synthetic payload sequence

SEQ ID NO: 1593 - DNA, 921 bp, Artificial Sequence
  Description of Artificial Sequence: Synthetic payload sequence
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttag

SEQ ID NO: 1594 - DNA, 918 bp, Artificial Sequence
  Description of Artificial Sequence: Synthetic payload sequence
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtaggaagaacgcctccatctctgtgagggcccaggatcgctactattcctctagctggtccgagtgggcctctgtgccctgtagc

SEQ ID NO: 1595 - DNA, 918 bp, Artificial Sequence
  Description of Artificial Sequence: Synthetic payload sequence
atctgggagctgaagaaggacgtgtacgtggtggagctggactggtatcccgatgcccctggcgagatggtggtgctgacctgcgacacaccagaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagtccaagagggagaagaaggaccgcgtgttcaccgataagacatctgccaccgtgatctgtaggaagaacgcctccatctctgtgagggcccaggatcgctactattcctctagctggtccgagtgggcctctgtgccctgtagc

SEQ ID NO: 1596 - DNA, 918 bp, Artificial Sequence
  Description of Artificial Sequence: Synthetic payload sequence
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggctccggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattatagcggccgctttacctgttggtggctgaccacaatcagcaccgatctgacattttccgtgaagtcctctaggggcagctccgacccccagggcgtgacatgcggagcagccaccctgtccgccgagcgggtgagaggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatcagggacatcatcaagcccgatccacccaagaacctgcagctgaagcctctgaagaattctcgccaggtggaggtgagctgggagtacccagacacctggagcacaccccactcttatttcagcctgaccttttgcgtgcaggtgcagggcaagtctaagcgggagaagaaggacagagtgttcaccgataagacaagcgccaccgtgatctgtcggaagaacgcctccatctctgtgcgggcccaggatagatactattcctctagctggtccgagtgggcctctgtgccctgtagc

SEQ ID NO: 1597 - DNA, 918 bp, Artificial Sequence
  Description of Artificial Sequence: Synthetic payload sequence
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgaggtgcgaggccaagaattatagcggccgctttacctgttggtggctgaccacaatcagcaccgatctgacattttccgtgaagtctagcagaggctcctctgacccccagggcgtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtcggaagaacgcctccatctctgtgcgggcccaggatagatactattctagctcctggtccgagtgggcctctgtgccctgtagc

SEQ ID NO: 1598 - DNA, 918 bp, Artificial Sequence; identical to SEQ ID NO: 1590
  Description of Artificial Sequence: Synthetic payload sequence

SEQ ID NO: 1599 - DNA, 918 bp, Artificial Sequence; identical to SEQ ID NO: 1591
  Description of Artificial Sequence: Synthetic payload sequence

SEQ ID NO: 1600 - DNA, 918 bp, Artificial Sequence
  Description of Artificial Sequence: Synthetic payload sequence
atctgggagctgaagaaggacgtgtacgtggtggagctggactggtatcccgatgcccctggcgagatggtggtgctgacctgcgacacacccgaggaggatggcatcacctggacactggatcagtctagcgaggtgctgggctccggcaagaccctgacaatccaggtgaaggagttcggcgacgccggccagtacacctgtcacaagggcggcgaggtgctgtcccactctctgctgctgctgcacaagaaggaggacggcatctggtctacagacatcctgaaggatcagaaggagcctaagaacaagaccttcctgcggtgcgaggccaagaattatagcggccggttcacctgttggtggctgaccacaatcagcaccgatctgacattttccgtgaagtcctctcggggcagctccgacccacagggagtgacatgcggagcagccaccctgtccgccgagagggtgcgcggcgataacaaggagtacgagtattccgtggagtgccaggaggactctgcctgtccagcagcagaggagagcctgccaatcgaagtgatggtggatgccgtgcacaagctgaagtacgagaattatacatctagcttctttatccgggacatcatcaagcccgatccccctaagaacctgcagctgaagcctctgaagaattctagacaggtggaggtgagctgggagtaccccgacacctggagcacacctcacagctatttctccctgaccttttgcgtgcaggtgcagggcaagtccaagagggagaagaaggaccgcgtgttcaccgataagacatctgccaccgtgatctgtcggaagaacgccagcatctccgtgagggcccaggatcgctactattcctctagctggtctgagtgggccagcgtgccctgttcc

SEQ ID NO: 1601 - DNA, 918 bp, Artificial Sequence
  Description of Artificial Sequence: Synthetic payload sequence
atctgggagctgaagaaggacgtgtacgtggtggagctggactggtatcctgatgccccaggcgagatggtggtgctgacatgcgacacccccgaggaggatggcatcacatggaccctggatcagtcctctgaggtgctgggctccggcaagacactgaccatccaggtgaaggagttcggcgacgccggccagtacacctgtcacaagggaggagaggtgctgagccactccctgctgctgctgcacaagaaggaggacggcatctggtccaccgacatcctgaaggatcagaaggagcccaagaacaagacattcctgagatgcgaggccaagaattatagcggcaggtttacctgttggtggctgacaaccatctccacagatctgaccttttctgtgaagagctcccggggctctagcgaccctcagggagtgacctgcggagcagccacactgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacctcctctttctttatcagagacatcatcaagccagatcctccaaagaacctgcagctgaagcccctgaagaatagcaggcaggtggaggtgtcctgggagtacccagacacatggagcaccccccacagctatttctccctgacattttgcgtgcaggtgcagggcaagtccaagcgcgagaagaaggaccgggtgttcacagataagacctctgccacagtgatctgtcgcaagaacgcctctatcagcgtgcgcgcccaggatcggtactatagctcctcttggtctgagtgggccagcgtgccttgttcc

SEQ ID NO: 1602 - DNA, 918 bp, Artificial Sequence
  Description of Artificial Sequence: Synthetic payload sequence
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattattctggcaggttcacctgttggtggctgaccacaatcagcaccgatctgacattttccgtgaagtctagccggggctcctctgacccccagggagtgacatgcggagcagccaccctgtccgccgagagggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctagacaggtggaggtgagctgggagtacccagacacctggagcacaccccactcctatttctctctgaccttttgcgtgcaggtgcagggcaagagcaagagggagaagaaggacagagtgttcaccgataagacatccgccaccgtgatctgtcggaagaacgcctccatctctgtgcgggcccaggatcgctactattctagctcctggagcgagtgggcatccgtgccatgttct

SEQ ID NO: 1603 - protein, 197 aa, Artificial Sequence; identical to SEQ ID NO: 735
  Description of Artificial Sequence: Synthetic payload sequence

SEQ ID NO: 1604 - DNA, 594 bp, Artificial Sequence
  Description of Artificial Sequence: Synthetic payload sequence
agaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 1605 - DNA, 594 bp, Artificial Sequence
  Description of Artificial Sequence: Synthetic payload sequence
cgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 1606 - DNA, 594 bp, Artificial Sequence
  Description of Artificial Sequence: Synthetic payload sequence
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 1607 - DNA, 594 bp, Artificial Sequence
  Description of Artificial Sequence: Synthetic payload sequence
agaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctcttga

SEQ ID NO: 1608 - DNA, 591 bp, Artificial Sequence
  Description of Artificial Sequence: Synthetic payload sequence
agaaatctgccagtggcaacccctgacccaggaatgttcccttgcctgcaccacagccagaacctgctgcgggccgtgtccaatatgctgcagaaggccagacagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgacagagtgatgtcctatctgaacgcctct

SEQ ID NO: 1609 - DNA, 591 bp, Artificial Sequence
  Description of Artificial Sequence: Synthetic payload sequence
agaaatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatcc

SEQ ID NO: 1610 - DNA, 594 bp, Artificial Sequence
  Description of Artificial Sequence: Synthetic payload sequence
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagctaa

SEQ ID NO: 1611 - DNA, 597 bp, Artificial Sequence
  Description of Artificial Sequence: Synthetic payload sequence
agaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagcggatcc

SEQ ID NO: 1612 - DNA, 597 bp, Artificial Sequence
  Description of Artificial Sequence: Synthetic payload sequence
cggaatctgcctgtggcaacccccgaccctggaatgttcccatgcctgcaccacagccagaacctgctgcgcgccgtgtccaatatgctgcagaaggcccggcagaccctggagttttacccatgtacaagcgaggagatcgaccacgaggatatcaccaaggataagacatccaccgtggaggcatgcctgccactggagctgacaaagaacgagtcttgtctgaacagccgggagacaagcttcatcacaaacggctcttgcctggccagccggaagacctcctttatgatggccctgtgcctgagctccatctacgaggacctgaagatgtatcaggtggagttcaagacaatgaacgccaagctgctgatggaccccaagcgccagatctttctggatcagaatatgctggccgtgatcgacgagctgatgcaggccctgaactttaatagcgagacagtgccccagaagtctagcctggaggagcctgatttctacaagacaaagatcaagctgtgcatcctgctgcacgccttccggatcagagccgtgaccatcgacagagtgatgtcttatctgaatgccagcggatcc

SEQ ID NO: 1613 - DNA, 591 bp, Artificial Sequence
  Description of Artificial Sequence: Synthetic payload sequence
cgcaatctgccagtggcaacccctgacccaggaatgttcccttgcctgcaccacagccagaacctgctgcgggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagagctgtctgaattccagggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgccacagaagtcctctctggaggagcccgatttctacaagaccaagatcaagctgtgcatcctgctgcacgccttcaggatcagggccgtgaccatcgacagagtgatgagctatctgaacgccagc

SEQ ID NO: 1614 - DNA, 591 bp, Artificial Sequence
  Description of Artificial Sequence: Synthetic payload sequence
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagt

SEQ ID NO: 1615 - protein, 114 aa, Homo sapiens; identical to SEQ ID NO: 718

SEQ ID NO: 1616 - DNA, 345 bp, Homo sapiens; identical to SEQ ID NO: 168

SEQ ID NO: 1617 - DNA, 345 bp, Artificial Sequence
  Description of Artificial Sequence: Synthetic payload sequence
aactgggtgaacgtgatctccgacctgaagaagatcgaggacctgatccagtccatgcacatcgacgccaccctgtacaccgagagcgacgtgcaccctagctgcaaggtgaccgccatgaagtgcttcctgctggagctgcaggtgatcagcctggagagcggcgatgccagcatccacgacacagtggagaacctgatcatcctggccaacaacagcctgagcagcaacggcaatgtgaccgagagcggctgcaaggagtgcgaggagctggaggagaagaacatcaaggagttcctgcagtccttcgtgcacatcgtgcagatgttcatcaacaccagctaa

SEQ ID NO: 1618 - DNA, 345 bp, Artificial Sequence
  Description of Artificial Sequence: Synthetic payload sequence
aactgggtcaacgtgatcagcgacctgaagaagatcgaggacctcatccagtccatgcacattgacgccaccctgtacaccgagtccgatgtgcaccctagctgcaaggtgaccgccatgaaatgcttcctgctggagctgcaggtcatctccttagaaagcggcgatgcctccatccacgacaccgtggagaacctgatcatcctggccaataactccctgagcagcaacggcaacgtgaccgagagcggctgcaaagagtgtgaagagctggaggagaagaacattaaggagttcctgcagagcttcgtgcacatcgtgcaaatgttcatcaacaccagctaa

SEQ ID NO: 1619 - DNA, 342 bp, Artificial Sequence
  Description of Artificial Sequence: Synthetic payload sequence
aactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttct

SEQ ID NO: 1620 - DNA, 342 bp, Artificial Sequence
  Description of Artificial Sequence: Synthetic payload sequence
aattgggtcaacgtgatcagcgacctgaagaagatcgaggacctgatccagagcatgcacatcgacgccacactgtacaccgagtccgatgtgcaccctagctgcaaagtgaccgccatgaagtgctttctgctggaactgcaagtgatcagcctggaaagcggcgacgccagcatccacgataccgtggaaaatctgatcatcctggccaacaacagcctgagcagcaacggcaatgtgaccgagagcggctgcaaagagtgcgaggaactggaagagaagaacatcaaagagttcctccagagcttcgtccacatcgtgcagatgttcatcaacaccagc

SEQ ID NO: 1621 - protein, 237 aa, Homo sapiens; identical to SEQ ID NO: 724

SEQ ID NO: 1622 - DNA, 714 bp, Homo sapiens
atcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatga

SEQ ID NO: 1623 - DNA, 711 bp, Artificial Sequence
  Description of Artificial Sequence: Synthetic construct
attacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttg

SEQ ID NO: 1624 - DNA, 711 bp, Artificial Sequence
  Description of Artificial Sequence: Synthetic payload sequence
atcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagatcccgctctggttcaccagaggcctgctcctccatctacagtgacaacagctggcgtgacccctcagcctgagtctctgtctccatctggaaaagagcctgccgccagctctcccagctctaacaatactgctgccaccacagccgccatcgtgcctggatctcagctgatgcctagcaagagccctagcaccggcacaacagagatcagctctcacgagtctagccacggcaccccatctcagaccacagccaagaattgggagctgaccgcctctgcctctcatcagccacctggtgtttaccctcaaggccactctgataccaccgtggccatcagcacaagcacagtgctgctgtgtggactgtctgccgtgtctctgctggcctgctacctgaagtctagacagacacctcctctggccagcgtggaaatggaagccatggaagctctgcctgtgacatggggcaccagcagcagagatgaggacctcgagaattgcagccaccacctg

SEQ ID NO: 1625 - protein, 235 aa, Artificial Sequence
  Description of Artificial Sequence: Synthetic polypeptide
LSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 1626 - DNA, 705 bp, Artificial Sequence
  Description of Artificial Sequence: Synthetic polynucleotide
ttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaag

SEQ ID NO: 1627 - DNA, 576 bp, Artificial Sequence
  Description of Artificial Sequence: Synthetic construct
cgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataa

SEQ ID NO: 1628 - protein, 5 aa, Artificial Sequence
  Description of Artificial Sequence: Synthetic linker
GGSGG

SEQ ID NO: 1629 - DNA, 15 bp, Artificial Sequence
  Description of Artificial Sequence: Synthetic linker
ggaggcagcggagga

SEQ ID NO: 1630 - DNA, 15 bp, Artificial Sequence
  Description of Artificial Sequence: Synthetic linker
ggaggctctggagga

SEQ ID NO: 1631 - DNA, 15 bp, Artificial Sequence
  Description of Artificial Sequence: Synthetic linker
ggaggctccggcgga

SEQ ID NO: 1632 - DNA, 15 bp, Artificial Sequence
  Description of Artificial Sequence: Synthetic linker
ggaggctccggcgga

SEQ ID NO: 1633 - DNA, 15 bp, Artificial Sequence
  Description of Artificial Sequence: Synthetic linker
ggaggatctggagga

SEQ ID NO: 1634 - DNA, 10 bp, Artificial Sequence
  Description of Artificial Sequence: Synthetic linker
  modified_base (7)..(10): a, c, t or g
agtggannnn

SEQ ID NO: 1635 - protein, 15 aa, Artificial Sequence
  Description of Artificial Sequence: Synthetic linker
GGGGSGGGGSGGGGS

SEQ ID NO: 1636 - DNA, 45 bp, Artificial Sequence
  Description of Artificial Sequence: Synthetic linker
ggaggaggaggatccggaggaggaggatctggcggcggcggcagc

SEQ ID NO: 1637 - DNA, 45 bp, Artificial Sequence
  Description of Artificial Sequence: Synthetic linker
ggaggaggaggatccggaggaggaggatctggcggaggaggcagc

SEQ ID NO: 1638 - DNA, 45 bp, Artificial Sequence
  Description of Artificial Sequence: Synthetic linker
ggaggaggaggaagcggaggaggaggatccggcggaggaggctct

SEQ ID NO: 1639 - DNA, 45 bp, Artificial Sequence
  Description of Artificial Sequence: Synthetic linker
ggaggaggaggcagcggaggaggaggttctggaggaggcggcagc

SEQ ID NO: 1640 - DNA, 45 bp, Artificial Sequence
  Description of Artificial Sequence: Synthetic linker
ggcggcggcggctctggaggaggaggcagcggcggaggaggctcc

SEQ ID NO: 1641 - DNA, 45 bp, Artificial Sequence
  Description of Artificial Sequence: Synthetic linker
ggaggaggaggcagcggcggaggaggctccggcggcggcggctct

SEQ ID NO: 1642 - protein, 4 aa, Artificial Sequence
  Description of Artificial Sequence: Synthetic linker
GGSG

SEQ ID NO: 1643 - DNA, 12 bp, Artificial Sequence
  Description of Artificial Sequence: Synthetic linker
ggaggatctgga

SEQ ID NO: 1644 - protein, 22 aa, Artificial Sequence
  Description of Artificial Sequence: Synthetic linker
MLLLVTSLLLCELPHPAFLLIP

SEQ ID NO: 1645 - DNA, 66 bp, Artificial Sequence
  Description of Artificial Sequence: Synthetic linker
atgcttctcctggtgacaagccttctgctctgtgagttaccacacccagcattcctcctgatccca

SEQ ID NO: 1646 - protein, 26 aa, Artificial Sequence
  Description of Artificial Sequence: Synthetic linker
SGGGSGGGGSGGGGSGGGGSGGGSLQ

SEQ ID NO: 1647 - DNA, 78 bp, Artificial Sequence
  Description of Artificial Sequence: Synthetic linker
tcaggtggcggtagtggtgggggaggatctggaggcggaggaagcgggggtggaggttcaggaggagggagcttgcaa

SEQ ID NO: 1648 - DNA, 78 bp, Artificial Sequence
  Description of Artificial Sequence: Synthetic linker
tcaggtggcggtagtggtgggggaggatctggaggcggaggaagcgggggtggaggttcaggtggaggcagcttgcaa

SEQ ID NO: 1649 - DNA, 78 bp, Artificial Sequence
  Description of Artificial Sequence: Synthetic linker
tccggtggaggtagcggtggagggggttctggtggaggaggttctggaggtggaggttctggcggtgggtccttgcaa

SEQ ID NO: 1650 - DNA, 78 bp, Artificial Sequence
  Description of Artificial Sequence: Synthetic linker
tctggcggaggaagcggaggcggaggatctggtggtggtggatctggcggcggtggtagtggcggaggttctctgcaa

SEQ ID NO: 1651 - DNA, 78 bp, Artificial Sequence
  Description of Artificial Sequence: Synthetic linker
tccggggggggtagcgggggagggggttccggcgggggagggtctggagggggaggttccggcggggggtccttgcaa

SEQ ID NO: 1652 - DNA, 78 bp, Artificial Sequence
  Description of Artificial Sequence: Synthetic linker
tctggcggaggatctggaggaggcggatctggaggaggaggcagtggaggcggaggatctggcggaggatctctgcag

SEQ ID NO: 1653 - DNA, 78 bp, Artificial Sequence; identical to SEQ ID NO: 1650
  Description of Artificial Sequence: Synthetic linker

SEQ ID NO: 1654 - protein, 12 aa, Artificial Sequence
  Description of Artificial Sequence: Synthetic cleavage site
ESRRVRRNKRSK

SEQ ID NO: 1655 - DNA, 36 bp, Artificial Sequence; identical to SEQ ID NO: 1337
  Description of Artificial Sequence: Synthetic cleavage site

SEQ ID NO: 1656 - DNA, 36 bp, Artificial Sequence; identical to SEQ ID NO: 1338
  Description of Artificial Sequence: Synthetic cleavage site

SEQ ID NO: 1657 - DNA, 36 bp, Artificial Sequence; identical to SEQ ID NO: 1339
  Description of Artificial Sequence: Synthetic cleavage site

SEQ ID NO: 1658 - DNA, 10 bp, Artificial Sequence
  Description of Artificial Sequence: Synthetic BamH1 restriction site
  modified_base (7)..(10): a, c, t or g
ggatccnnnn

SEQ ID NO: 1659 - DNA, 32 bp, Artificial Sequence
  Description of Artificial Sequence: Synthetic oligonucleotide
gcttgccacaacccacaaggagacgaccttcc

SEQ ID NO: 1660 - protein, 9 aa, Artificial Sequence
  Description of Artificial Sequence: Synthetic HA Tag
YPYDVPDYA

SEQ ID NO: 1661 - DNA, 27 bp, Artificial Sequence
  Description of Artificial Sequence: Synthetic HA Tag
tacccatacgatgttccagattacgct

SEQ ID NO: 1662 - DNA, 27 bp, Artificial Sequence
  Description of Artificial Sequence: Synthetic HA Tag
tatccttacgatgtgcccgactatgct

SEQ ID NO: 1663 - DNA, 27 bp, Artificial Sequence
  Description of Artificial Sequence: Synthetic HA Tag
tatccgtacgacgtaccagactacgca

SEQ ID NO: 1664 - DNA, 321 bp, Artificial Sequence
  Description of Artificial Sequence: Synthetic destabilizing domain (DD)
ggagtgcaggtggagacaatctctcctggcgatggccggaccttcccaaagagaggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgatgtggagctgctgaagccagag

SEQ ID NO: 1665 - DNA, 321 bp, Artificial Sequence
  Description of Artificial Sequence: Synthetic destabilizing domain (DD)
ggcgtgcaggtggagacaatctcccctggcgatggccggaccttcccaaagagaggccagacatgcgtggtgcactacaccggcatgctggaggacggcaagaaggtggacagctcccgggatagaaacaagcctttcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgacgtggagctgctgaagccagag

SEQ ID NO: 1666 - DNA, 321 bp, Artificial Sequence
  Description of Artificial Sequence: Synthetic destabilizing domain (DD)
ggagtgcaggtggagacaatctcccctggcgatggcaggaccttcccaaagcgcggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtccgtgggacagcgcgccaagctgacaatctctcctgattacgcatatggagcaaccggacacccaggaatcatcccacctcacgccaccctggtgtttgacgtggagctgctgaagcccgag

SEQ ID NO: 1667 - DNA, 321 bp, Artificial Sequence
  Description of Artificial Sequence: Synthetic destabilizing domain (DD)
ggcgtgcaggtggagacaatcagcccaggcgacggacgcacctttccaaagaggggacagacatgcgtggtgcactacaccggcatgctggaggatggcaagaaggtggactcctctagagatcggaataagccattcaagtttatgctgggcaagcaggaagtgatcagaggctgggaggagggagtggcacagatgtctgtgggacagcgggccaagctgacaatcagccctgactatgcatacggagcaaccggacacccaggaatcatcccaccacacgccacactggtgttcgatgtggagctgctgaagcctgag

SEQ ID NO: 1668 - DNA, 321 bp, Artificial Sequence
  Description of Artificial Sequence: Synthetic destabilizing domain (DD)
ggagtgcaggtggagacaatctccccaggcgacggcagaacctttcccaagcggggccagacatgcgtggtgcactataccggcatgctggaggatggcaagaaggtggactcctctagagatcggaacaagccattcaagtttatgctgggcaagcaggaagtgatcagaggctgggaggagggagtggcacagatgtctgtgggacagcgggccaagctgacaatcagcccagactatgcatacggagcaaccggacaccctggaatcatccctccacacgccaccctggtgttcgatgtggagctgctgaagcctgag

SEQ ID NO: 1669 - DNA, 324 bp, Artificial Sequence
  Description of Artificial Sequence: Synthetic destabilizing domain (DD)
ggcgtgcaggtggagacaatcagccccggcgatggccggacctttcctaagagaggccagacatgcgtggtgcactacaccggcatgctgggcgacggcaagaaggtggacagctccagggatcgcaataagcccttcaagtttatgctgggcaagcaggaagtgatcaggggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtga

SEQ ID NO: 1670 - DNA, 324 bp, Artificial Sequence
  Description of Artificial Sequence: Synthetic destabilizing domain (DD)
ggagtgcaggtggagacaatcagccccggcgatggcaggacctttcctaagcgcggccagacatgcgtggtgcactacaccggcatgctgggcgacggcaagaaggtggacagctcccgggatagaaataagcccttcaagtttatgctgggcaagcaggaagtgatcagaggctgggaggagggagtggcacagatgtctgtgggacagggcgccaagctgacaatcagcccagattacgcatatggagcaaccggacacccaggaatcatcccaccccacgccaccctggtgttcgacgtggagctgctggagctggagtga

SEQ ID NO: 1671 - DNA, 324 bp, Artificial Sequence
  Description of Artificial Sequence: Synthetic destabilizing domain (DD)
ggcgtgcaggtggagacaatcagccccggcgatggccggacctttcctaagcgcggccagacatgcgtggtgcactacaccggcatgctgggcgacggcaagaaggtggacagctccagggatagaaacaagccattcaagtttatgctgggcaagcaggaagtgatcagaggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtga

SEQ ID NO: 1672 - DNA, 324 bp, Artificial Sequence
  Description of Artificial Sequence: Synthetic destabilizing domain (DD)
ggagtgcaggtggagacaatcagcccaggcgacggaaggacattcccaaagaggggacagacctgcgtggtgcactacacaggcatgctgggcgatggcaagaaggtggacagctcccgggatagaaacaagcccttcaagtttatgctgggcaagcaggaagtgatcaggggatgggaggagggagtggcacagatgtccgtgggacagggcgccaagctgaccatctctcctgactacgcctatggagcaacaggacacccaggaatcatcccacctcacgccaccctggtgtttgatgtggagctgctggagctggagtga

SEQ ID NO: 1673 - DNA, 321 bp, Artificial Sequence
  Description of Artificial Sequence: Synthetic destabilizing domain (DD)
ggagtgcaggtggagacaatcagcccaggcgacggaaggacattcccaaagaggggacagacctgcgtggtgcactacacaggcatgctgggcgatggcaagaaggtggacagctcccgggatagaaacaagcccttcaagtttatgctgggcaagcaggaagtgatcaggggatgggaggagggagtggcacagatgtccgtgggacagggcgccaagctgaccatctctcctgactacgcctatggagcaacaggacacccaggaatcatcccacctcacgccaccctggtgtttgatgtggagctgctggagctggag

SEQ ID NO: 1674 - DNA, 321 bp, Artificial Sequence
  Description of Artificial Sequence: Synthetic destabilizing domain (DD)
ggagtgcaggtggagacaatcagccccggcgatggcaggacctttcctaagcgcggccagacatgcgtggtgcactacaccggcatgctgggcgacggcaagaaggtggacagctcccgggatagaaataagcccttcaagtttatgctgggcaagcaggaagtgatcagaggctgggaggagggagtggcacagatgtctgtgggacagggcgccaagctgacaatcagcccagattacgcatatggagcaaccggacacccaggaatcatcccaccccacgccaccctggtgttcgacgtggagctgctggagctggag

SEQ ID NO: 1675 - DNA, 321 bp, Artificial Sequence
  Description of Artificial Sequence: Synthetic destabilizing domain (DD)
ggagtgcaggtggaaaccatctccccaggagacgggcgcaccttccccaagcgcggccagacctgcgtggtgcactacaccgggatgcttggagatggaaagaaagttgactcctcccgggacagaaacaagccctttaagtttatgctaggcaagcaggaggtgatccgaggctgggaagaaggggttgcccagatgagtgtgggtcagggagccaaactgactatatctccagattatgcctatggtgccactgggcacccaggcatcatcccaccacatgccactctcgtcttcgatgtggagcttctagaactggaa

SEQ ID NO: 1676 - DNA, 474 bp, Artificial Sequence
  Description of Artificial Sequence: Synthetic destabilizing domain (DD)
atctccctgatcgccgccctggccgtggattatgtgatcggcatggagaacgccatgccctggaatctgcccgccgacctggcctggttcaagaggaataccctgaacaagcccgtcatcatgggcaggcacacctgggaaagcatcggcagacccctgcccggcaggaagaacatcatcctgtccagccagcccggcaccgacgacagagtgacctgggtgaagagcgtggacgaagctatcgccgcttgcggcgacgtgcccgagatcatggtgatcggcggcggcagggtgatcgaacagttcctgcccaaggcccagaagctgtacctgacccacatcgatgccgaggtggaaggcgatacacacttccccgattacgaacctgacgactgggaaagcgtgttttccgaattccacgacgccgacgcccagaacagccacagctactgcttcgagatcctggaaagaagg

SEQ ID NO: 1677 - DNA, 477 bp, Artificial Sequence
  Description of Artificial Sequence: Synthetic destabilizing domain (DD)
atctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 1678 - DNA, 474 bp, Artificial Sequence
  Description of Artificial Sequence: Synthetic destabilizing domain (DD)
atctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgt

SEQ ID NO: 1679 - DNA, 474 bp, Artificial Sequence
  Description of Artificial Sequence: Synthetic destabilizing domain (DD)
atctctctgatcgccgccctggccgtggattacgtgatcggcatggagaacgccatgccatggaatctgccagcagacctggcatggttcaagaggaacacactgaataagccagtgatcatgggcagacacacctgggagtccatcggccggccactgccaggcagaaagaacatcatcctgagctcccagcccggcacagacgatagggtgacctgggtgaagagcgtggacgaggcaatcgcagcatgcggcgatgtgcctgagatcatggtcatcggaggaggacgcgtgatcgagcagttcctgccaaaggcccagaagctgtacctgacacacatcgatgccgaggtggagggcgacacccactttcctgattatgagccagacgattgggagtccgtgttctctgagtttcacgacgccgatgcccagaactctcacagctattgttttgagatcctggagcggaga

SEQ ID NO: 1680 - DNA, 474 bp, Artificial Sequence
  Description of Artificial Sequence: Synthetic destabilizing domain (DD)
atctccctgatcgccgccctggcagtggactacgtgatcggcatggagaacgccatgccctggaatctgcctgccgatctggcctggtttaagagaaacacactgaataagcccgtgatcatgggccggcacacctgggagtctatcggcaggcccctgcctggcaggaagaacatcatcctgtcctctcagcctggcacagacgatagagtgacctgggtgaagagcgtggacgaggcaatcgcagcatgtggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgcttcgagatcctggagaggaga

SEQ ID NO: 1681 - DNA, 474 bp, Artificial Sequence
  Description of Artificial Sequence: Synthetic destabilizing domain (DD)
atctccctgatcgccgccctggcagtggactacgtgatcggcatggagaacgccatgccctggaatctgcctgccgatctggcctggtttaagagaaacacactgaataagcccgtgatcatgggccggcacacctgggagagcatcggcagacctctgccaggccggaagaacatcatcctgtcctctcagcctggcacagacgatagagtgacctgggtgaagtccgtggacgaggcaatcgcagcatgcggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgtttcgagatcctggagagaaga

SEQ ID NO: 1682 - DNA, 477 bp, Artificial Sequence
  Description of Artificial Sequence: Synthetic destabilizing domain (DD)
atctctctgattgcggcgctggcagttgaccacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacaaaccggatgattgggagagcgtattctccgaattccatgatgcggatgcgcaaaactctcattcttactgttttgaaatcctggaacgtcgttga

SEQ ID NO: 1683 - DNA, 474 bp, Artificial Sequence
  Description of Artificial Sequence: Synthetic destabilizing domain (DD)
atctctctgattgcggcgctggcagttgaccacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacaaaccggatgattgggagagcgtattctccgaattccatgatgcggatgcgcaaaactctcattcttactgttttgaaatcctggaacgtcgt

SEQ ID NO: 1684 - DNA, 474 bp, Artificial Sequence
  Description of Artificial Sequence: Synthetic destabilizing domain (DD)
atctccctgatcgccgccctggcagtggaccacgtgatcggcatggagaacgccatgccatggaatctgcccgccgatctggcctggttcaagcggaacaccctgaataagccagtgatcatgggcagacacacatgggagtctatcggcaggcccctgcctggacgcaagaacatcatcctgagctcccagcccggcaccgacgatagggtgacatgggtgaagtccgtggacgaggcaatcgcagcatgcggcgatgtgcccgagatcatggtcatcggcggcggcagagtgtacgagcagttcctgcctaaggcccagaagctgtatctgacccacatcgacgccgaggtggagggcgacacacactttcctgattacaagccagacgattgggagtccgtgttctctgagtttcacgacgccgatgcccagaattctcacagctattgttttgagatcctggagcggaga

SEQ ID NO: 1685 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 1686 - DNA, 558 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttcagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgat

SEQ ID NO: 1687 - DNA, 561 bp, Artificial Sequence; identical to SEQ ID NO: 77
  Description of Artificial Sequence: Synthetic destabilizing domain (DD)

SEQ ID NO: 1688 - DNA, 561 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaattcatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 1689 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaattcatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 1690 - DNA, 558 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttcagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggagttcatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgat

SEQ ID NO: 1691 - DNA, 561 bp, Artificial Sequence; identical to SEQ ID NO: 83
  Description of Artificial Sequence: Synthetic destabilizing domain (DD)

SEQ ID NO: 1692 - DNA, 558 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttaagaggatgaccacaaccagctccgtggagggcaagcagaacctggtcatcatgggcaagaagacatggttctctatccccgagaagaaccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgat

SEQ ID NO: 1693 - DNA, 561 bp, Artificial Sequence; identical to SEQ ID NO: 85
  Description of Artificial Sequence: Synthetic destabilizing domain (DD)

SEQ ID NO: 1694 - DNA, 561 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttcttcagaatgaccacaacctcttcagtagaaggtaaacagaatctggtgattatgggtaagaagacctggttctccattcctgagaagttccgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 1695 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttcttcagaatgaccacaacctcttcagtagaaggtaaacagaatctggtgattatgggtaagaagacctggttctccattcctgagaagttccgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 1696 - DNA, 558 bp, Artificial Sequence
  Description of Artificial Sequence: Synthetic destabilizing domain (DD)
gtgggctccctgaactgcatcgtggccgtgagccagaacatgggcatcggcaagaatggcgacctgccttggccacctctgaggaacgagttcagatactttttcaggatgaccacaaccagctccgtggagggcaagcagaacctggtcatcatgggcaagaagacatggttctctatccccgagaagttccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgat

SEQ ID NO: 1697 - DNA, 1461 bp, Artificial Sequence
  Description of Artificial Sequence: Synthetic construct
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtga

SEQ ID NO: 1698 - DNA, 1782 bp, Artificial Sequence
  Description of Artificial Sequence: Synthetic construct
atggcactgccagtgacagccctgctgctgcctctggccctgctgctgcacgcagccagacctgacatccagatgacacagaccacaagctccctgagcgcctccctgggcgacagagtgaccatctcttgccgggccagccaggatatctccaagtatctgaactggtaccagcagaagcccgatggcacagtgaagctgctgatctatcacacctctcgcctgcacagcggcgtgccttccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataactccgccctgaagtctcggctgaccatcatcaaggacaactctaagagccaggtgttcctgaagatgaattccctgcagacagacgataccgccatctactattgcgccaagcactactattacggcggctcctatgccatggattactggggccagggcacatctgtgaccgtgtctagcggcgtgcaggtggagacaatcagcccaggcgacggacgcacctttccaaagaggggacagacatgcgtggtgcactacaccggcatgctggaggatggcaagaaggtggactcctctagagatcggaataagccattcaagtttatgctgggcaagcaggaagtgatcagaggctgggaggagggagtggcacagatgtctgtgggacagcgggccaagctgacaatcagccctgactatgcatacggagcaaccggacacccaggaatcatcccaccacacgccacactggtgttcgatgtggagctgctgaagcctgagacaacaaccccagcacccagacctccaacacctgcaccaaccatcgcaagccagcctctgtccctgaggcccgaggcatgtaggccagcagcaggaggcgccgtgcacacccggggcctggactttgcctgcgatatctatatctgggcaccactggcaggaacatgtggcgtgctgctgctgtccctggtcatcaccctgtattgcaagcgcggcaggaagaagctgctgtacatcttcaagcagccctttatgcgccctgtgcagacaacccaggaggaggacggctgcagctgtaggttcccagaggaggaggagggaggatgtgagctgagggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtga

SEQ ID NO: 1699 - DNA, 1935 bp, Artificial Sequence
  Description of Artificial Sequence: Synthetic construct
atggcactgcctgtgacagccctgctgctgccactggccctgctgctgcacgcagcccgccctgacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgaccatcatcaaggacaactctaagagccaggtgttcctgaagatgaattccctgcagacagacgataccgccatctactattgcgccaagcactactattacggcggctcttatgccatggattactggggccagggcacaagcgtgaccgtgtctagcatctccctgatcgccgccctggcagtggactacgtgatcggcatggagaacgccatgccctggaatctgcctgccgatctggcctggtttaagagaaacacactgaataagcccgtgatcatgggccggcacacctgggagtctatcggcaggcccctgcctggcaggaagaacatcatcctgtcctctcagcctggcacagacgatagagtgacctgggtgaagagcgtggacgaggcaatcgcagcatgtggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgcttcgagatcctggagaggagaaccacaaccccagcaccccgcccaccaacacctgcaccaaccatcgcctcccagccactgtctctgaggcccgaggcatgtaggcctgcagcaggaggcgccgtgcacaccaggggcctggactttgcctgcgatatctacatctgggcacctctggcaggaacatgtggcgtgctgctgctgtccctggtcatcaccctgtattgcaagcgcggcaggaagaagctgctgtacatcttcaagcagccttttatgcgcccagtgcagacaacccaggaggaggacggctgcagctgtaggttccctgaggaggaggagggaggatgtgagctgagggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaaggtga

SEQ ID NO: 1700 - DNA, 1782 bp, Artificial Sequence
  Description of Artificial Sequence: Synthetic construct
atggcactgccagtgacagccctgctgctgcctctggccctgctgctgcacgcagccagacctgacatccagatgacacagaccacaagctccctgagcgcctccctgggcgacagagtgaccatctcttgccgggccagccaggatatctccaagtatctgaactggtaccagcagaagccagatggcacagtgaagctgctgatctatcacacctctcgcctgcacagcggagtgccctccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataattccgccctgaagtctcggctgacaatcatcaaggacaactctaagagccaggtgtttctgaagatgaatagcctgcagacagacgataccgccatctactattgcgccaagcactactattacggcggctcctatgccatggattactggggccagggcacatctgtgaccgtgtctagcaccacaaccccagcacccagaccaccaacacctgcaccaaccatcgcaagccagcctctgtccctgcgcccagaggcatgcaggccagcagcaggaggagcagtgcacacccggggcctggacttcgcatgtgatggagtgcaggtggagacaatctccccaggcgacggcagaacctttcccaagcggggccagacatgcgtggtgcactataccggcatgctggaggatggcaagaaggtggactcctctagagatcggaacaagccattcaagtttatgctgggcaagcaggaagtgatcagaggctgggaggagggagtggcacagatgtctgtgggacagcgggccaagctgacaatcagcccagactatgcatacggagcaaccggacaccctggaatcatccctccacacgccaccctggtgttcgatgtggagctgctgaagcctgagatctacatctgggcaccactggcaggaacatgcggcgtgctgctgctgtccctggtcatcaccctgtattgtaagcgcggcaggaagaagctgctgtacatcttcaagcagccctttatgcgccctgtgcagacaacccaggaggaggacggctgcagctgtaggttccctgaggaggaggagggaggatgtgagctgagggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtga

SEQ ID NO: 1701 - DNA, 1935 bp, Artificial Sequence
  Description of Artificial Sequence: Synthetic construct
atggcactgcctgtgaccgccctgctgctgccactggccctgctgctgcacgcagcccgccctgacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgacaatcatcaaggacaactctaagagccaggtgtttctgaagatgaatagcctgcagacagacgataccgccatctactattgtgccaagcactactattacggcggcagctatgccatggattactggggccagggcacatccgtgaccgtgtctagcaccacaaccccagcacctcgcccaccaacaccagcaccaaccatcgcatcccagccactgtctctgcgccccgaggcatgcaggcctgcagcaggcggcgccgtgcacaccaggggcctggacttcgcctgtgatatctccctgatcgccgccctggcagtggactacgtgatcggcatggagaacgccatgccctggaatctgcctgccgatctggcctggtttaagagaaacacactgaataagcccgtgatcatgggccggcacacctgggagagcatcggcagacctctgccaggccggaagaacatcatcctgtcctctcagcctggcacagacgatagagtgacctgggtgaagtccgtggacgaggcaatcgcagcatgcggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaattcccactcttattgtttcgagatcctggagagaagaatctacatctgggcacctctggcaggaacatgcggcgtgctgctgctgtctctggtcatcaccctgtattgtaagcgcggcaggaagaagctgctgtacatcttcaagcagccttttatgcgcccagtgcagacaacccaggaggaggacggctgcagctgtaggttccctgaggaggaggagggaggatgcgagctgagggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaaggtga

SEQ ID NO: 1702 - DNA, 1950 bp, Artificial Sequence
  Description of Artificial Sequence: Synthetic construct
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggcagcggaggaatctccctgatcgccgccctggcagtggaccacgtgatcggcatggagaacgccatgccatggaatctgcccgccgatctggcctggttcaagcggaacaccctgaataagccagtgatcatgggcagacacacatgggagtctatcggcaggcccctgcctggacgcaagaacatcatcctgagctcccagcccggcaccgacgatagggtgacatgggtgaagtccgtggacgaggcaatcgcagcatgcggcgatgtgcccgagatcatggtcatcggcggcggcagagtgtacgagcagttcctgcctaaggcccagaagctgtatctgacccacatcgacgccgaggtggagggcgacacacactttcctgattacaagccagacgattgggagtccgtgttctctgagtttcacgacgccgatgcccagaattctcacagctattgttttgagatcctggagcggagatga

SEQ ID NO: 1703 - DNA, 1797 bp, Artificial Sequence
  Description of Artificial Sequence: Synthetic construct
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggctctggaggaggagtgcaggtggagacaatcagcccaggcgacggaaggacattcccaaagaggggacagacctgcgtggtgcactacacaggcatgctgggcgatggcaagaaggtggacagctcccgggatagaaacaagcccttcaagtttatgctgggcaagcaggaagtgatcaggggatgggaggagggagtggcacagatgtccgtgggacagggcgccaagctgaccatctctcctgactacgcctatggagcaacaggacacccaggaatcatcccacctcacgccaccctggtgtttgatgtggagctgctggagctggagtga

SEQ ID NO: 1704 - DNA, 2034 bp, Artificial Sequence; identical to SEQ ID NO: 165
  Description of Artificial Sequence: Synthetic construct

SEQ ID NO: 1705 - DNA, 2034 bp, Artificial Sequence; identical to SEQ ID NO: 166
  Description of Artificial Sequence: Synthetic construct

SEQ ID NO: 1706 - DNA, 2034 bp, Artificial Sequence; identical to SEQ ID NO: 167
  Description of Artificial Sequence: Synthetic construct

SEQ ID NO: 1707 - DNA, 2034 bp, Artificial Sequence
  Description of Artificial Sequence: Synthetic construct
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggaggcagcggaggagtgggctccctgaactgcatcgtggccgtgagccagaacatgggcatcggcaagaatggcgacctgccttggccacctctgaggaacgagttcagatactttttcaggatgaccacaaccagctccgtggagggcaagcagaacctggtcatcatgggcaagaagacatggttctctatccccgagaagttccgccctctgaagggccggatcaatctggtgctgagcagagagctgaaggagccaccacagggagcacacttcctgagccggagcctggacgatgccctgaagctgaccgagcagcccgagctggccaacaaggtggacatggtgtggatcgtgggcggctctagcgtgatcaaggaggccatgaatcacccaggccacctgaagctgttcgtgacaagaatcatgcaggactttgagtccgataccttctttcccgagatcgacctggagaagtacaagctgctgcctgagtatccaggcgtgctgtctgatgtgcaggaggagaagggcatcaagtacaagttcgaggtgtatgagaagaatgattga

SEQ ID NO: 1708 - DNA, 1824 bp, Artificial Sequence
  Description of Artificial Sequence: Synthetic construct
atggcactgcctgtgaccgccctgctgctgccactggccctgctgctgcacgcagccaggccttctggaggcgtgcaggtggagacaatcagcccaggcgacggacgcaccttcccaaagaggggacagacatgcgtggtgcactacaccggcatgctggaggatggcaagaaggtggacagctccagagatcggaacaagccattcaagtttatgctgggcaagcaggaagtgatcagaggatgggaggagggagtggcacagatgagcgtgggacagcgggccaagctgacaatctcccctgactatgcatacggagcaaccggacacccaggaatcatcccacctcacgccacactggtgttcgacgtggagctgctgaagcctgaggagtccaggagagtgcggcgcaacaagcggtctaaggatatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtga

SEQ ID NO: 1709 - DNA, 1977 bp, Artificial Sequence
  Description of Artificial Sequence: Synthetic construct
atggcactgcctgtgaccgccctgctgctgccactggccctgctgctgcacgcagccaggccttctggaatcagcctgatcgccgccctggcagtggactacgtgatcggcatggagaacgccatgccctggaatctgcctgccgatctggcctggttcaagagaaacacactgaataagcccgtgatcatgggccggcacacctgggagtccatcggcaggcccctgcctggcaggaagaacatcatcctgagctcccagcctggcacagacgatagagtgacctgggtgaagagcgtggacgaggcaatcgcagcatgcggcgatgtgcccgagatcatggtcatcggcggcggcagagtgatcgagcagttcctgcctaaggcccagaagctgtatctgacacacatcgacgccgaggtggagggcgacacccactttccagattacgagcccgacgattgggagtccgtgttctctgagtttcacgacgccgatgcccagaacagccactcctactgcttcgagatcctggagaggagagagtctcggcgcgtgaggagaaataagagaagcaaggacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtga

SEQ ID NO: 1710 - DNA, 2061 bp, Artificial Sequence; identical to SEQ ID NO: 176
  Description of Artificial Sequence: Synthetic construct

SEQ ID NO: 1711 - DNA, 2061 bp, Artificial Sequence; identical to SEQ ID NO: 177
  Description of Artificial Sequence: Synthetic construct

SEQ ID NO: 1712 - DNA, 2034 bp, Artificial Sequence; identical to SEQ ID NO: 165
  Description of Artificial Sequence: Synthetic polynucleotide

SEQ ID NO: 1713 - DNA, 1467 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatcctga

SEQ ID NO: 1714 - DNA, 1527 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggagctactaacttcagcctgctgaagcaggctggagacgtggaggagaaccctggacctggatcctga

SEQ ID NO: 1715 - DNA, 1494 bp, Artificial Sequence
  Description of Artificial Sequence: Synthetic polynucleotide
atggcactgcctgtgaccgccctgctgctgccactggccctgctgctgcacgcagccaggccctatccttacgatgtgcccgactatgctgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatcctga

SEQ ID NO: 1716 - DNA, 1509 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggagtggtgagtccaggagagtgcggcgcaacaagaggagcaagggatcctga

SEQ ID NO: 1717 - DNA, 1509 bp, Artificial Sequence; identical to SEQ ID NO: 1716
  Description of Artificial Sequence: Synthetic polynucleotide

SEQ ID NO: 1718 - DNA, 3158 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcacgcgttatccgtacgacgtaccagactacgcaggagtgcaggtggaaaccatctccccaggagacgggcgcaccttccccaagcgcggccagacctgcgtggtgcactacaccgggatgcttggagatggaaagaaagttgactcctcccgggacagaaacaagccctttaagtttatgctaggcaagcaggaggtgatccgaggctgggaagaaggggttgcccagatgagtgtgggtcagggagccaaactgactatatctccagattatgcctatggtgccactgggcacccaggcatcatcccaccacatgccactctcgtcttcgatgtggagcttctagaactggaatgaatgcatcgatccgcggcggccgctacgtaaattccgccccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgatgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 1719 - DNA, 2232 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 1720 - DNA, 2658 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggttcaggagctactaacttcagcctgctgaagcaggctggagacgtggaggagaaccctggacctaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 1721 - DNA, 2724 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggttcaggagctactaacttcagcctgctgaagcaggctggagacgtggaggagaaccctggacctatgcttctcctggtgacaagccttctgctctgtgagttaccacacccagcattcctcctgatcccaaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 1722 - DNA, 2712 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatccggagctactaacttcagcctgctgaagcaggctggagacgtggaggagaaccctggacctatggactggacctggattctgtttctggtggccgctgccacaagagtgcacagcaattgggtcaacgtgatcagcgacctgaagaagatcgaggacctgatccagagcatgcacatcgacgccacactgtacaccgagtccgatgtgcaccctagctgcaaagtgaccgccatgaagtgctttctgctggaactgcaagtgatcagcctggaaagcggcgacgccagcatccacgataccgtggaaaatctgatcatcctggccaacaacagcctgagcagcaacggcaatgtgaccgagagcggctgcaaagagtgcgaggaactggaagagaagaacatcaaagagttcctccagagcttcgtccacatcgtgcagatgttcatcaacaccagctctggcggaggaagcggaggcggaggatctggtggtggtggatctggcggcggtggtagtggcggaggttctctgcaaatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagatcccgctctggttcaccagaggcctgctcctccatctacagtgacaacagctggcgtgacccctcagcctgagtctctgtctccatctggaaaagagcctgccgccagctctcccagctctaacaatactgctgccaccacagccgccatcgtgcctggatctcagctgatgcctagcaagagccctagcaccggcacaacagagatcagctctcacgagtctagccacggcaccccatctcagaccacagccaagaattgggagctgaccgcctctgcctctcatcagccacctggtgtttaccctcaaggccactctgataccaccgtggccatcagcacaagcacagtgctgctgtgtggactgtctgccgtgtctctgctggcctgctacctgaagtctagacagacacctcctctggccagcgtggaaatggaagccatggaagctctgcctgtgacatggggcaccagcagcagagatgaggacctcgagaattgcagccaccacctgtag

SEQ ID NO: 1723 - protein, 21 aa, Artificial Sequence
  Description of Artificial Sequence: Synthetic Signal Sequence
LLLVTSLLLCELPHPAFLLIP

SEQ ID NO: 1724 - DNA, 90 bp, Artificial Sequence
  Description of Artificial Sequence: Synthetic Leader sequence
atggccccgcggcgggcgcgcggctgccggaccctcggtctcccggcgctgctactgctgctgctgctccggccgccggcgacgcggggc

SEQ ID NO: 1725 - protein, 4 aa, Artificial Sequence
  Description of Artificial Sequence: Synthetic Linker
ASFE

SEQ ID NO: 1726 - DNA, 12 bp, Artificial Sequence
  Description of Artificial Sequence: Synthetic Linker
gctagcttcgaa

SEQ ID NO: 1727 - DNA, 10 bp, Artificial Sequence
  Description of Artificial Sequence: Synthetic Linker
  modified_base (7)..(10): a, c, t or g
ggttccnnnn

SEQ ID NO: 1728 - DNA, 10 bp, Artificial Sequence
  Description of Artificial Sequence: Synthetic Linker
  modified_base (7)..(10): a, c, t or g
actagtnnnn

SEQ ID NO: 1729 - DNA, 10 bp, Artificial Sequence
  Description of Artificial Sequence: Synthetic Linker
  modified_base (7)..(10): a, c, t or g
atgcacnnnn

SEQ ID NO: 1730 - protein, 42 aa, Homo sapiens; identical to SEQ ID NO: 426

SEQ ID NO: 1731 - DNA, 126 bp, Homo sapiens
aagcgcggccggaagaagctgctgtatatcttcaagcagcccttcatgcggcccgtgcagacaacccaggaggaggacggctgcagctgtaggttccctgaggaggaggagggcggctgtgagctg

SEQ ID NO: 1732 - protein, 243 aa, Artificial Sequence
  Description of Artificial Sequence: Synthetic Construct
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGSGKPGSGEGSGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 1733 - DNA, 729 bp, Artificial Sequence
  Description of Artificial Sequence: Synthetic Construct
gatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaagggtctacatctggatctgggaagccgggttctggtgagggttctggtgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggacgtgtggggtcaaggaaccctggtcaccgtctcctcg

SEQ ID NO: 1734 - protein, 45 aa, Artificial Sequence; identical to SEQ ID NO: 601
  Description of Artificial Sequence: Synthetic Construct

SEQ ID NO: 1735 - DNA, 135 bp, Artificial Sequence
  Description of Artificial Sequence: Synthetic Construct
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 1736 - protein, 24 aa, Artificial Sequence
  Description of Artificial Sequence: Synthetic Construct
IYIWAPLAGTCGVLLLSLVITLYC

SEQ ID NO: 1737 - DNA, 72 bp, Artificial Sequence
  Description of Artificial Sequence: Synthetic Construct
atctacatctgggcgcccttggccgggacttgtggggtccttctcctgtcactggttatcaccctttactgc

SEQ ID NO: 1738 - protein, 112 aa, Homo sapiens; identical to SEQ ID NO: 419

SEQ ID NO: 1739 - DNA, 336 bp, Homo sapiens
agagtgaagttttccaggtctgccgatgccccagcctacaagcagggccagaatcagctgtataacgagctgaatctgggccggagagaggagtacgacgtgctggataagaggaggggacgggaccccgagatgggaggcaagccacggagaaagaacccccaggagggcctgtacaatgagctgcagaaggacaagatggccgaggcctattctgagatcggcatgaagggagagaggcgccggggcaagggacacgatggcctgtaccagggcctgagcacagccaccaaggacacctatgatgcactgcacatgcaggccctgcctccaagg

SEQ ID NO: 1740 - protein, 186 aa, Artificial Sequence; identical to SEQ ID NO: 13
  Description of Artificial Sequence: Synthetic Destabilizing Domain (DD)

SEQ ID NO: 1741 - DNA, 558 bp, Artificial Sequence; identical to SEQ ID NO: 1685
  Description of Artificial Sequence: Synthetic Destabilizing Domain (DD)

SEQ ID NO: 1742 - DNA, 558 bp, Artificial Sequence; identical to SEQ ID NO: 1686
  Description of Artificial Sequence: Synthetic Destabilizing Domain (DD)

SEQ ID NO: 1743 - DNA, 558 bp, Artificial Sequence; identical to SEQ ID NO: 1692
  Description of Artificial Sequence: Synthetic Destabilizing Domain (DD)

SEQ ID NO: 1744 - DNA, 2061 bp, Artificial Sequence
  Description of Artificial Sequence: Synthetic Construct
atgctgctgctcgtgacatctctgctgctgtgcgagctgccccaccccgcctttctgctgatccccgatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaagggtctacatctggatctgggaagccgggttctggtgagggttctggtgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggacgtgtggggtcaaggaaccctggtcaccgtctcctcggctagcttcgaaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatggatctatctacatctgggcgcccttggccgggacttgtggggtccttctcctgtcactggttatcaccctttactgcactagtaaacggggcagaaagaaactcctgtatatattcaaacaaccatttatgagaccagtacaaactactcaagaggaagatggctgtagctgccgatttccagaagaagaagaaggaggatgtgaactgcatatgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 1745 - protein, 246 aa, Artificial Sequence
  Description of Artificial Sequence: Synthetic scFV sequence
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 1746 - DNA, 738 bp, Artificial Sequence
  Description of Artificial Sequence: Synthetic scFV sequence
gacatcgtgctgacacagagccctgcatccctggcaatgtccctgggcaagagggcaaccatctcttgcagggcctctgagagcgtgtccgtgatcggcgcccacctgatccactggtaccagcagaagccaggacagccacctaagctgctgatctatctggcctccaacctggagacaggagtgcctgcacggttctctggcagcggctccggcaccgactttacactgaccatcgatccagtggaggaggacgatgtggccatctactcttgcctgcagagcagaatcttccccaggacatttggcggcggcaccaagctggagatcaagggctctacaagcggctccggcaagcctggctccggagagggctctaccaagggacagatccagctggtgcagtccggacccgagctgaagaagcctggcgagacagtgaagatcagctgtaaggcctccggctacacattcaccgattattctatcaactgggtgaagagggcaccaggcaagggcctgaagtggatgggctggatcaatacagagacacgggagcccgcctacgcctatgacttcagaggcaggttcgcctttagcctggagacatctgccagcaccgcctacctgcagatcaacaatctgaagtacgaggatacagccacctatttttgcgccctggactacagctatgccatggattattggggccagggcacatccgtgaccgtgagctcc

SEQ ID NO: 1747 - protein, 69 aa, Homo sapiens; identical to SEQ ID NO: 607

SEQ ID NO: 1748 - DNA, 207 bp, Homo sapiens
accacaaccccagcacctagaccaccaacaccagcacccaccatcgcctctcagccactgagcctgcgccccgaggcatgtaggcctgcagcaggcggcgccgtgcacaccaggggcctggactttgcctgcgatatctacatctgggcaccactggcaggaacatgtggcgtgctgctgctgtccctggtcatcaccctgtactgc

SEQ ID NO: 1749 - DNA, 63 bp, Homo sapiens; identical to SEQ ID NO: 1321

SEQ ID NO: 1750 - DNA, 63 bp, Artificial Sequence; identical to SEQ ID NO: 1322
  Description of Artificial Sequence: Synthetic Signal Sequence

SEQ ID NO: 1751 - DNA, 63 bp, Artificial Sequence; identical to SEQ ID NO: 1323
  Description of Artificial Sequence: Synthetic Signal Sequence

SEQ ID NO: 1752 - DNA, 63 bp, Artificial Sequence; identical to SEQ ID NO: 1324
  Description of Artificial Sequence: Synthetic Signal Sequence

SEQ ID NO: 1753 - DNA, 63 bp, Artificial Sequence; identical to SEQ ID NO: 1325
  Description of Artificial Sequence: Synthetic Signal Sequence

SEQ ID NO: 1754 - DNA, 63 bp, Artificial Sequence
  Description of Artificial Sequence: Synthetic Leader sequence
atggcactgcctgtgaccgccctgctgctgccactggccctgctgctgcacgcagccagaccc

SEQ ID NO: 1755 - protein, 158 aa, Artificial Sequence; identical to SEQ ID NO: 1174
  Description of Artificial Sequence: Synthetic Destabilizing Domain (DD)

SEQ ID NO: 1756 - DNA, 474 bp, Artificial Sequence; identical to SEQ ID NO: 1678
  Description of Artificial Sequence: Synthetic Destabilized Domain (DD)

SEQ ID NO: 1757 - DNA, 474 bp, Artificial Sequence; identical to SEQ ID NO: 1676
  Description of Artificial Sequence: Synthetic Destabilizing Domain (DD)

SEQ ID NO: 1758 - DNA, 477 bp, Artificial Sequence; identical to SEQ ID NO: 1677
  Description of Artificial Sequence: Synthetic Destabilizing Domain (DD)

SEQ ID NO: 1759 - DNA, 474 bp, Artificial Sequence; identical to SEQ ID NO: 1678
  Description of Artificial Sequence: Synthetic Destabilizing Domain (DD)

SEQ ID NO: 1760 - DNA, 474 bp, Artificial Sequence; identical to SEQ ID NO: 1679
  Description of Artificial Sequence: Synthetic Destabilizing Domain (DD)

SEQ ID NO: 1761 - DNA, 474 bp, Artificial Sequence; identical to SEQ ID NO: 1680
  Description of Artificial Sequence: Synthetic Destabilizing Domain (DD)

SEQ ID NO: 1762 - DNA, 474 bp, Artificial Sequence; identical to SEQ ID NO: 1681
  Description of Artificial Sequence: Synthetic Destabilizing Domain (DD)

SEQ ID NO: 1763 - protein, 107 aa, Artificial Sequence; identical to SEQ ID NO: 1177
  Description of Artificial Sequence: Synthetic Destabilizing Domain (DD)

SEQ ID NO: 1764 - DNA, 321 bp, Artificial Sequence
  Description of Artificial Sequence: Synthetic Destabilizing Domain (DD)
ggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggag

SEQ ID NO: 1765 - DNA, 324 bp, Artificial Sequence; identical to SEQ ID NO: 1669
  Description of Artificial Sequence: Synthetic Destabilizing Domain (DD)

SEQ ID NO: 1766 - DNA, 324 bp, Artificial Sequence; identical to SEQ ID NO: 1670
  Description of Artificial Sequence: Synthetic Destabilizing Domain (DD)

SEQ ID NO: 1767 - DNA, 324 bp, Artificial Sequence; identical to SEQ ID NO: 1671
  Description of Artificial Sequence: Synthetic Destabilizing Domain (DD)

SEQ ID NO: 1768 - DNA, 324 bp, Artificial Sequence; identical to SEQ ID NO: 1672
  Description of Artificial Sequence: Synthetic Destabilizing Domain (DD)

SEQ ID NO: 1769 - DNA, 321 bp, Artificial Sequence; identical to SEQ ID NO: 1673
  Description of Artificial Sequence: Synthetic Destabilizing Domain (DD)

SEQ ID NO: 1770 - DNA, 321 bp, Artificial Sequence; identical to SEQ ID NO: 1674
  Description of Artificial Sequence: Synthetic Destabilizing Domain (DD)

SEQ ID NO: 1771 - DNA, 321 bp, Artificial Sequence; identical to SEQ ID NO: 1675
  Description of Artificial Sequence: Synthetic Destabilizing Domain (DD)

SEQ ID NO: 1772 - DNA, 1473 bp, Artificial Sequence
  Description of Artificial Sequence: Synthetic Construct
atggcactgcctgtgaccgccctgctgctgccactggccctgctgctgcacgcagccagacccgacatcgtgctgacacagagccctgcatccctggcaatgtccctgggcaagagggcaaccatctcttgcagggcctctgagagcgtgtccgtgatcggcgcccacctgatccactggtaccagcagaagccaggacagccacctaagctgctgatctatctggcctccaacctggagacaggagtgcctgcacggttctctggcagcggctccggcaccgactttacactgaccatcgatccagtggaggaggacgatgtggccatctactcttgcctgcagagcagaatcttccccaggacatttggcggcggcaccaagctggagatcaagggctctacaagcggctccggcaagcctggctccggagagggctctaccaagggacagatccagctggtgcagtccggacccgagctgaagaagcctggcgagacagtgaagatcagctgtaaggcctccggctacacattcaccgattattctatcaactgggtgaagagggcaccaggcaagggcctgaagtggatgggctggatcaatacagagacacgggagcccgcctacgcctatgacttcagaggcaggttcgcctttagcctggagacatctgccagcaccgcctacctgcagatcaacaatctgaagtacgaggatacagccacctatttttgcgccctggactacagctatgccatggattattggggccagggcacatccgtgaccgtgagctccaccacaaccccagcacctagaccaccaacaccagcacccaccatcgcctctcagccactgagcctgcgccccgaggcatgtaggcctgcagcaggcggcgccgtgcacaccaggggcctggactttgcctgcgatatctacatctgggcaccactggcaggaacatgtggcgtgctgctgctgtccctggtcatcaccctgtactgcaagcgcggccggaagaagctgctgtatatcttcaagcagcccttcatgcggcccgtgcagacaacccaggaggaggacggctgcagctgtaggttccctgaggaggaggagggcggctgtgagctgagagtgaagttttccaggtctgccgatgccccagcctacaagcagggccagaatcagctgtataacgagctgaatctgggccggagagaggagtacgacgtgctggataagaggaggggacgggaccccgagatgggaggcaagccacggagaaagaacccccaggagggcctgtacaatgagctgcagaaggacaagatggccgaggcctattctgagatcggcatgaagggagagaggcgccggggcaagggacacgatggcctgtaccagggcctgagcacagccaccaaggacacctatgatgcactgcacatgcaggccctgcctccaaggtga

SEQ ID NO: 1773 - DNA, 1800 bp, Artificial Sequence
  Description of Artificial Sequence: Synthetic Construct
atggcactgcctgtgaccgccctgctgctgccactggccctgctgctgcacgcagccagacccgacatcgtgctgacacagagccctgcatccctggcaatgtccctgggcaagagggcaaccatctcttgcagggcctctgagagcgtgtccgtgatcggcgcccacctgatccactggtaccagcagaagccaggacagccacctaagctgctgatctatctggcctccaacctggagacaggagtgcctgcacggttctctggcagcggctccggcaccgactttacactgaccatcgatccagtggaggaggacgatgtggccatctactcttgcctgcagagcagaatcttccccaggacatttggcggcggcaccaagctggagatcaagggctctacaagcggctccggcaagcctggctccggagagggctctaccaagggacagatccagctggtgcagtccggacccgagctgaagaagcctggcgagacagtgaagatcagctgtaaggcctccggctacacattcaccgattattctatcaactgggtgaagagggcaccaggcaagggcctgaagtggatgggctggatcaatacagagacacgggagcccgcctacgcctatgacttcagaggcaggttcgcctttagcctggagacatctgccagcaccgcctacctgcagatcaacaatctgaagtacgaggatacagccacctatttttgcgccctggactacagctatgccatggattattggggccagggcacatccgtgaccgtgagctccaccacaaccccagcacctagaccaccaacaccagcacccaccatcgcctctcagccactgagcctgcgccccgaggcatgtaggcctgcagcaggcggcgccgtgcacaccaggggcctggactttgcctgcgatatctacatctgggcaccactggcaggaacatgtggcgtgctgctgctgtccctggtcatcaccctgtactgcaagcgcggccggaagaagctgctgtatatcttcaagcagcccttcatgcggcccgtgcagacaacccaggaggaggacggctgcagctgtaggttccctgaggaggaggagggcggctgtgagctgagagtgaagttttccaggtctgccgatgccccagcctacaagcagggccagaatcagctgtataacgagctgaatctgggccggagagaggagtacgacgtgctggataagaggaggggacgggaccccgagatgggaggcaagccacggagaaagaacccccaggagggcctgtacaatgagctgcagaaggacaagatggccgaggcctattctgagatcggcatgaagggagagaggcgccggggcaagggacacgatggcctgtaccagggcctgagcacagccaccaaggacacctatgatgcactgcacatgcaggccctgcctccaaggtctggcggcgtgcaggtggagacaatcagcccaggcgacggaaggacattcccaaagaggggacagacctgcgtggtgcactacacaggcatgctgggcgatggcaagaaggtggacagctcccgggatagaaacaagcccttcaagtttatgctgggcaagcaggaagtgatcaggggatgggaggagggagtggcacagatgtccgtgggacagggcgccaagctgaccatctctcctgactacgcctatggagcaacaggacacccaggaatcatcccacctcacgccaccctggtgtttgatgtggagctgctggagctggagtga

SEQ ID NO: 1774 - DNA, 1953 bp, Artificial Sequence
  Description of Artificial Sequence: Synthetic Construct
atggcactgcctgtgaccgccctgctgctgccactggccctgctgctgcacgcagccagacccgacatcgtgctgacacagagccctgcatccctggcaatgtccctgggcaagagggcaaccatctcttgcagggcctctgagagcgtgtccgtgatcggcgcccacctgatccactggtaccagcagaagccaggacagccacctaagctgctgatctatctggcctccaacctggagacaggagtgcctgcacggttctctggcagcggctccggcaccgactttacactgaccatcgatccagtggaggaggacgatgtggccatctactcttgcctgcagagcagaatcttccccaggacatttggcggcggcaccaagctggagatcaagggctctacaagcggctccggcaagcctggctccggagagggctctaccaagggacagatccagctggtgcagtccggacccgagctgaagaagcctggcgagacagtgaagatcagctgtaaggcctccggctacacattcaccgattattctatcaactgggtgaagagggcaccaggcaagggcctgaagtggatgggctggatcaatacagagacacgggagcccgcctacgcctatgacttcagaggcaggttcgcctttagcctggagacatctgccagcaccgcctacctgcagatcaacaatctgaagtacgaggatacagccacctatttttgcgccctggactacagctatgccatggattattggggccagggcacatccgtgaccgtgagctccaccacaaccccagcacctagaccaccaacaccagcacccaccatcgcctctcagccactgagcctgcgccccgaggcatgtaggcctgcagcaggcggcgccgtgcacaccaggggcctggactttgcctgcgatatctacatctgggcaccactggcaggaacatgtggcgtgctgctgctgtccctggtcatcaccctgtactgcaagcgcggccggaagaagctgctgtatatcttcaagcagcccttcatgcggcccgtgcagacaacccaggaggaggacggctgcagctgtaggttccctgaggaggaggagggcggctgtgagctgagagtgaagttttccaggtctgccgatgccccagcctacaagcagggccagaatcagctgtataacgagctgaatctgggccggagagaggagtacgacgtgctggataagaggaggggacgggaccccgagatgggaggcaagccacggagaaagaacccccaggagggcctgtacaatgagctgcagaaggacaagatggccgaggcctattctgagatcggcatgaagggagagaggcgccggggcaagggacacgatggcctgtaccagggcctgagcacagccaccaaggacacctatgatgcactgcacatgcaggccctgcctccaaggtccggaatctctctgatcgccgccctggcagtggactacgtgatcggcatggagaacgccatgccatggaatctgcccgccgatctggcctggttcaagcggaacaccctgaataagccagtgatcatgggcagacacacatgggagtctatcggcaggcccctgcctggacgcaagaacatcatcctgagctcccagcccggcaccgacgatagggtgacatgggtgaagtccgtggacgaggcaatcgcagcatgcggcgatgtgcccgagatcatggtcatcggcggcggcagagtgatcgagcagttcctgcctaaggcccagaagctgtacctgacccacatcgacgccgaggtggagggcgacacacactttcctgattatgagccagacgattgggagagcgtgttctccgagtttcacgacgccgatgcccagaacagccacagctattgttttgagatcctggagcggagatga

SEQ ID NO: 1775 - protein, 20 aa, Homo sapiens
MYRMQLLSCIALSLALVTNS

SEQ ID NO: 1776 - DNA, 60 bp, Artificial Sequence
  Description of Artificial Sequence: Synthetic Signal Sequence
atgtaccgaatgcaactgctgagctgcatcgccctgagcctggcactcgtgaccaacagc

SEQ ID NO: 1777 - DNA, 60 bp, Homo sapiens
atgtacaggatgcaactcctgtcttgcattgcactaagtcttgcacttgtcacaaacagt

SEQ ID NO: 1778 - DNA, 60 bp, Artificial Sequence
  Description of Artificial Sequence: Synthetic Signal Sequence
atgtacaggatgcagctgctgagctgcatcgccctgagcctggccctggtgaccaacagc

SEQ ID NO: 1779 - DNA, 60 bp, Artificial Sequence
  Description of Artificial Sequence: Synthetic Signal Sequence
atgtacagaatgcagctgctgagctgcatcgccctgtccctcgccctggtgaccaactcc

SEQ ID NO: 1780 - protein, 6 aa, Artificial Sequence
  Description of Artificial Sequence: Synthetic Linker
EFSTEF

SEQ ID NO: 1781 - DNA, 18 bp, Artificial Sequence
  Description of Artificial Sequence: Synthetic Linker
gagttcagcaccgagttt

SEQ ID NO: 1782 - DNA, 10 bp, Artificial Sequence
  Description of Artificial Sequence: Synthetic Linker
  modified_base (7)..(10): a, c, t or g
atgcacnnnn

SEQ ID NO: 1783 - DNA, 402 bp, Artificial Sequence
  Description of Artificial Sequence: Synthetic Construct
gcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 1784 - DNA, 402 bp, Homo sapiens
gcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttga

SEQ ID NO: 1785 - protein, 107 aa, Artificial Sequence; identical to SEQ ID NO: 1176
  Description of Artificial Sequence: Synthetic Destabilizing Domain (DD)

SEQ ID NO: 1786 - DNA, 321 bp, Artificial Sequence
  Description of Artificial Sequence: Synthetic Destabilized Domain (DD)
ggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgag

SEQ ID NO: 1787 - DNA, 321 bp, Artificial Sequence; identical to SEQ ID NO: 1664
  Description of Artificial Sequence: Synthetic Destabilizing Domain (DD)

SEQ ID NO: 1788 - DNA, 321 bp, Artificial Sequence; identical to SEQ ID NO: 1665
  Description of Artificial Sequence: Synthetic Destabilizing Domain (DD)

SEQ ID NO: 1789 - DNA, 321 bp, Artificial Sequence; identical to SEQ ID NO: 1666
  Description of Artificial Sequence: Synthetic Destabilizing Domain (DD)

SEQ ID NO: 1790 - DNA, 321 bp, Artificial Sequence; identical to SEQ ID NO: 1667
  Description of Artificial Sequence: Synthetic Destabilizing Domain (DD)

SEQ ID NO: 1791 - DNA, 321 bp, Artificial Sequence; identical to SEQ ID NO: 1668
  Description of Artificial Sequence: Synthetic Destabilizing Domain (DD)

SEQ ID NO: 1792 - DNA, 807 bp, Artificial Sequence
  Description of Artificial Sequence: Synthetic Construct
atgtaccgaatgcaactgctgagctgcatcgccctgagcctggcactcgtgaccaacagcgagttcagcaccgagtttggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgagatgcacgcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 1793 - DNA, 462 bp, Artificial Sequence
  Description of Artificial Sequence: Synthetic Construct
atgtaccgaatgcaactgctgagctgcatcgccctgagcctggcactcgtgaccaacagcgcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 1794 - DNA, 960 bp, Artificial Sequence
  Description of Artificial Sequence: Synthetic Construct
atgtaccgaatgcaactgctgagctgcatcgccctgagcctggcactcgtgaccaacagcgagttcagcaccgagtttatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgtatgcacgcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 1795 - DNA, 603 bp, Artificial Sequence
  Description of Artificial Sequence: Synthetic promoter
aagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctactaga

SEQ ID NO: 1796 - DNA, 1339 bp, Artificial Sequence
  Description of Artificial Sequence: Synthetic promoter
cgatagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgag

SEQ ID NO: 1797 - DNA, 399 bp, Artificial Sequence
  Description of Artificial Sequence: Synthetic promoter
ccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcc

SEQ ID NO: 1798 - DNA, 1335 bp, Artificial Sequence
  Description of Artificial Sequence: Synthetic promoter
gagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 1799 - protein, 19 aa, Artificial Sequence
  Description of Artificial Sequence: Synthetic spacer
ATNFSLLKQAGDVEENPGP

SEQ ID NO: 1800 - DNA, 57 bp, Artificial Sequence
  Description of Artificial Sequence: Synthetic spacer
gcaaccaattttagtctacttaaacaagcaggtgatgtagaagaaaatccaggtcca

SEQ ID NO: 1801 - protein, 9 aa, Homo sapiens
SARNRQKRS

SEQ ID NO: 1802 - DNA, 27 bp, Homo sapiens
agcgccaggaatcgccagaagcggtcc

SEQ ID NO: 1803 - protein, 8 aa, Homo sapiens
ARNRQKRS

SEQ ID NO: 1804 - DNA, 24 bp, Homo sapiens
gcccggaatagacagaagagatct

SEQ ID NO: 1805 - protein, 20 aa, Artificial Sequence
  Description of Artificial Sequence: Synthetic cleavable peptide
GATNFSLLKQAGDVEENPGP

SEQ ID NO: 1806 - DNA, 60 bp, Artificial Sequence
  Description of Artificial Sequence: Synthetic cleavable peptide
ggagctactaacttcagcctgctgaagcaggctggagacgtggaggagaaccctggacct

SEQ ID NO: 1807 - protein, 306 aa, Artificial Sequence
  Description of Artificial Sequence: Synthetic payload sequence
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPNNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 1808 - DNA, 918 bp, Artificial Sequence
  Description of Artificial Sequence: Synthetic payload sequence
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaacaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcaccgacaagacctcagccacggtcatctgccgcaaaaatgccagcattagcgtgcgggcccaggaccgctactatagctcatcttggagcgaatgggcatctgtgccctgcagt

SEQ ID NO: 1809 - DNA, 594 bp, Homo sapiens; identical to SEQ ID NO: 1604

SEQ ID NO: 1810 - DNA, 594 bp, Artificial Sequence; identical to SEQ ID NO: 1606
  Description of Artificial Sequence: Synthetic Construct

SEQ ID NO: 1811 - DNA, 529 bp, Artificial Sequence
  Description of Artificial Sequence: Synthetic Construct
gctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 1812 - DNA, 594 bp, Artificial Sequence; identical to SEQ ID NO: 1607
  Description of Artificial Sequence: Synthetic Construct

SEQ ID NO: 1813 - DNA, 591 bp, Artificial Sequence; identical to SEQ ID NO: 1608
  Description of Artificial Sequence: Synthetic Construct

SEQ ID NO: 1814 - DNA, 588 bp, Artificial Sequence
  Description of Artificial Sequence: Synthetic Construct
aatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatcc

SEQ ID NO: 1815 - DNA, 594 bp, Artificial Sequence; identical to SEQ ID NO: 1610
  Description of Artificial Sequence: Synthetic Construct

SEQ ID NO: 1816 - DNA, 597 bp, Artificial Sequence; identical to SEQ ID NO: 1611
  Description of Artificial Sequence: Synthetic Construct

SEQ ID NO: 1817 - DNA, 597 bp, Artificial Sequence; identical to SEQ ID NO: 1612
  Description of Artificial Sequence: Synthetic Construct

SEQ ID NO: 1818 - DNA, 591 bp, Artificial Sequence; identical to SEQ ID NO: 1613
  Description of Artificial Sequence: Synthetic Construct

SEQ ID NO: 1819 - DNA, 558 bp, Artificial Sequence; identical to SEQ ID NO: 86
  Description of Artificial Sequence: Synthetic destabilizing domain (DD)

SEQ ID NO: 1820 - DNA, 558 bp, Artificial Sequence
  Description of Artificial Sequence: Synthetic destabilizing domain (DD)
gttggttcgctaaactgcatcgtcgctgtgtcccagaacatgggcgtcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 1821 - protein, 652 aa, Artificial Sequence
  Description of Artificial Sequence: Synthetic construct
MCHQQLVISWFSLVFLASPLVAGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEGGSGGIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1822 - DNA, 1959 bp, Artificial Sequence
  Description of Artificial Sequence: Synthetic construct
atgtgccaccagcagctggtcatcagctggttctccctggtgtttctggcatcccctctggtggcaggagtgcaggtggagacaatctctcctggcgatggccggaccttcccaaagagaggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgatgtggagctgctgaagccagagggaggatccggaggcatctgggagctgaagaaggacgtgtacgtggtggagctggactggtatcccgatgcccctggcgagatggtggtgctgacctgcgacacacctgaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtaggaagaacgcctccatctctgtgagggcccaggatcgctactattcctctagctggtccgagtgggcctctgtgccctgtagcggaggaggaggatccggaggaggaggatctggcggcggcggcagccgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 1823 - protein, 653 aa, Artificial Sequence
  Description of Artificial Sequence: Synthetic construct
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEGGSGGMCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1824 - DNA, 1962 bp, Artificial Sequence
  Description of Artificial Sequence: Synthetic construct
atgggcgtgcaggtggagacaatctcccctggcgatggccggaccttcccaaagagaggccagacatgcgtggtgcactacaccggcatgctggaggacggcaagaaggtggacagctcccgggatagaaacaagcctttcaagtttatgctgggcaagcaggaagtgatcaggggatgggaggagggagtggcacagatgtctgtgggccagagagccaagctgacaatcagccctgattacgcatatggagcaaccggacacccaggaatcatcccacctcacgccaccctggtgtttgacgtggagctgctgaagccagagggaggatctggaggaatgtgccaccagcagctggtcatcagctggttctccctggtgtttctggccagccctctggtggccatctgggagctgaagaaggacgtgtacgtggtggagctggactggtatcccgatgcccctggcgagatggtggtgctgacctgcgacacaccagaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagtccaagagggagaagaaggaccgcgtgttcaccgataagacatctgccaccgtgatctgtaggaagaacgcctccatctctgtgagggcccaggatcgctactattcctctagctggtccgagtgggcctctgtgccctgtagcggaggaggaggatccggaggaggaggatctggcggcggcggcagccgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 1825 - protein, 656 aa, Artificial Sequence
  Description of Artificial Sequence: Synthetic construct
MCHQQLVISWFSLVFLASPLVAGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPESARNRQKRSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1826 - DNA, 1971 bp, Artificial Sequence
  Description of Artificial Sequence: Synthetic construct
atgtgccaccagcagctggtcatcagctggttctccctggtgtttctggcaagccctctggtggcaggagtgcaggtggagacaatctcccctggcgatggcaggaccttcccaaagcgcggccagacatgcgtggtgcactacaccggcatgctggaggacggcaagaaggtggacagctcccgggatagaaacaagccattcaagtttatgctgggcaagcaggaagtgatcaggggatgggaggagggagtggcacagatgtccgtgggacagcgcgccaagctgacaatctctcctgattacgcatatggagcaaccggacacccaggaatcatcccacctcacgccaccctggtgtttgacgtggagctgctgaagcccgagagcgccaggaatcgccagaagcggtccatctgggagctgaagaaggacgtgtacgtggtggagctggactggtatcccgatgcccctggcgagatggtggtgctgacctgcgacacacctgaggaggatggcatcacctggacactggatcagtctagcgaggtgctgggctccggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattatagcggccgctttacctgttggtggctgaccacaatcagcaccgatctgacattttccgtgaagtcctctaggggcagctccgacccccagggcgtgacatgcggagcagccaccctgtccgccgagcgggtgagaggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatcagggacatcatcaagcccgatccacccaagaacctgcagctgaagcctctgaagaattctcgccaggtggaggtgagctgggagtacccagacacctggagcacaccccactcttatttcagcctgaccttttgcgtgcaggtgcagggcaagtctaagcgggagaagaaggacagagtgttcaccgataagacaagcgccaccgtgatctgtcggaagaacgcctccatctctgtgcgggcccaggatagatactattcctctagctggtccgagtgggcctctgtgccctgtagcggaggaggaggatccggaggaggaggatctggcggcggcggcagcagaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctcttga

SEQ ID NO: 1827 - protein, 655 aa, Artificial Sequence
  Description of Artificial Sequence: Synthetic construct
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASARNRQKRSGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1828 - DNA, 1968 bp, Artificial Sequence
  Description of Artificial Sequence: Synthetic construct
atgtgccaccagcagctggtcatcagctggttctccctggtgtttctggcatccccactggtggcaatctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgaggtgcgaggccaagaattatagcggccgctttacctgttggtggctgaccacaatcagcaccgatctgacattttccgtgaagtctagcagaggctcctctgacccccagggcgtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtcggaagaacgcctccatctctgtgcgggcccaggatagatactattctagctcctggtccgagtgggcctctgtgccctgtagcggaggaggaggatccggaggaggaggatctggcggaggaggcagcagaaatctgccagtggcaacccctgacccaggaatgttcccttgcctgcaccacagccagaacctgctgcgggccgtgtccaatatgctgcagaaggccagacagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgacagagtgatgtcctatctgaacgcctctgcccggaatagacagaagagatctggcgtgcaggtggagacaatcagccccggcgatggccggacctttcctaagagaggccagacatgcgtggtgcactacaccggcatgctgggcgacggcaagaaggtggacagctccagggatcgcaataagcccttcaagtttatgctgggcaagcaggaagtgatcaggggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtga

SEQ ID NO: 1829 - protein, 651 aa, Artificial Sequence
  Description of Artificial Sequence: Synthetic construct
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1830 - DNA, 1956 bp, Artificial Sequence
  Description of Artificial Sequence: Synthetic construct
atgtgccaccagcagctggtcatcagctggttctccctggtgtttctggcatccccactggtggcaatctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtctagccggggctcctctgacccacagggagtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagtccaagcgggagaagaaggacagagtgttcaccgataagacatctgccaccgtgatctgtcggaagaacgcctccatctctgtgagggcccaggatcgctactattctagctcctggagcgagtgggcatccgtgccatgttctggaggaggaggaagcggaggaggaggatccggcggaggaggctctagaaatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatccggaggatctggaggagtgcaggtggagacaatcagccccggcgatggcaggacctttcctaagcgcggccagacatgcgtggtgcactacaccggcatgctgggcgacggcaagaaggtggacagctcccgggatagaaataagcccttcaagtttatgctgggcaagcaggaagtgatcagaggctgggaggagggagtggcacagatgtctgtgggacagggcgccaagctgacaatcagcccagattacgcatatggagcaaccggacacccaggaatcatcccaccccacgccaccctggtgttcgacgtggagctgctggagctggagtga

SEQ ID NO: 1831 - protein, 540 aa, Artificial Sequence
  Description of Artificial Sequence: Synthetic construct
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1832 - DNA, 1623 bp, Artificial Sequence; identical to SEQ ID NO: 172
  Description of Artificial Sequence: Synthetic construct

SEQ ID NO: 1833 - protein, 710 aa, Artificial Sequence
  Description of Artificial Sequence: Synthetic construct
MCHQQLVISWFSLVFLASPLVAISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRESRRVRRNKRSKIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1834 - DNA, 2130 bp, Artificial Sequence
  Description of Artificial Sequence: Synthetic construct
atgtgccaccagcagctggtcatctcttggttcagcctggtgtttctggcctcccccctggtggccatctctctgatcgccgccctggccgtggattacgtgatcggcatggagaacgccatgccatggaatctgccagcagacctggcatggttcaagaggaacacactgaataagccagtgatcatgggcagacacacctgggagtccatcggccggccactgccaggcagaaagaacatcatcctgagctcccagcccggcacagacgatagggtgacctgggtgaagagcgtggacgaggcaatcgcagcatgcggcgatgtgcctgagatcatggtcatcggaggaggacgcgtgatcgagcagttcctgccaaaggcccagaagctgtacctgacacacatcgatgccgaggtggagggcgacacccactttcctgattatgagccagacgattgggagtccgtgttctctgagtttcacgacgccgatgcccagaactctcacagctattgttttgagatcctggagcggagagagtctaggcgcgtgcggagaaataagcggagcaagatctgggagctgaagaaggacgtgtacgtggtggagctggactggtatcccgatgcccctggcgagatggtggtgctgacctgcgacacacccgaggaggatggcatcacctggacactggatcagtctagcgaggtgctgggctccggcaagaccctgacaatccaggtgaaggagttcggcgacgccggccagtacacctgtcacaagggcggcgaggtgctgtcccactctctgctgctgctgcacaagaaggaggacggcatctggtctacagacatcctgaaggatcagaaggagcctaagaacaagaccttcctgcggtgcgaggccaagaattatagcggccggttcacctgttggtggctgaccacaatcagcaccgatctgacattttccgtgaagtcctctcggggcagctccgacccacagggagtgacatgcggagcagccaccctgtccgccgagagggtgcgcggcgataacaaggagtacgagtattccgtggagtgccaggaggactctgcctgtccagcagcagaggagagcctgccaatcgaagtgatggtggatgccgtgcacaagctgaagtacgagaattatacatctagcttctttatccgggacatcatcaagcccgatccccctaagaacctgcagctgaagcctctgaagaattctagacaggtggaggtgagctgggagtaccccgacacctggagcacacctcacagctatttctccctgaccttttgcgtgcaggtgcagggcaagtccaagagggagaagaaggaccgcgtgttcaccgataagacatctgccaccgtgatctgtcggaagaacgccagcatctccgtgagggcccaggatcgctactattcctctagctggtctgagtgggccagcgtgccctgttccggcggcggcggctctggaggaggaggcagcggcggaggaggctccagaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagc

SEQ ID NO: 1835 - protein, 738 aa, Artificial Sequence
  Description of Artificial Sequence: Synthetic construct
MCHQQLVISWFSLVFLASPLVAVGSLNCIVAVSQNMGIGKNGDLPWPPLRNEFRYFFRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKNDESRRVRRNKRSKIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1836 - DNA, 2214 bp, Artificial Sequence; identical to SEQ ID NO: 173
  Description of Artificial Sequence: Synthetic construct

SEQ ID NO: 1837 - protein, 659 aa, Artificial Sequence
  Description of Artificial Sequence: Synthetic construct
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASESRRVRRNKRSKGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1838 - DNA, 1980 bp, Artificial Sequence
  Description of Artificial Sequence: Synthetic construct
atgtgccaccagcagctggtcatctcttggttcagcctggtgtttctggcatccccactggtggcaatctgggagctgaagaaggacgtgtacgtggtggagctggactggtatcccgatgcccctggcgagatggtggtgctgacctgcgacacacctgaggaggatggcatcacctggacactggatcagagctccgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattattctggcaggttcacctgttggtggctgaccacaatcagcaccgatctgacattttccgtgaagtctagccggggctcctctgacccccagggagtgacatgcggagcagccaccctgtccgccgagagggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctagacaggtggaggtgagctgggagtacccagacacctggagcacaccccactcctatttctctctgaccttttgcgtgcaggtgcagggcaagagcaagagggagaagaaggacagagtgttcaccgataagacatccgccaccgtgatctgtcggaagaacgcctccatctctgtgcgggcccaggatcgctactattctagctcctggagcgagtgggcatccgtgccatgttctggaggaggaggcagcggcggaggaggctccggcggcggcggctctcgcaatctgccagtggcaacccctgacccaggaatgttcccttgcctgcaccacagccagaacctgctgcgggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagagctgtctgaattccagggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgccacagaagtcctctctggaggagcccgatttctacaagaccaagatcaagctgtgcatcctgctgcacgccttcaggatcagggccgtgaccatcgacagagtgatgagctatctgaacgccagcgagtccaggagagtgcggcgcaacaagaggagcaagggcgtgcaggtggagacaatcagccccggcgatggccggacctttcctaagcgcggccagacatgcgtggtgcactacaccggcatgctgggcgacggcaagaaggtggacagctccagggatagaaacaagccattcaagtttatgctgggcaagcaggaagtgatcagaggatgggaggagggagtggcacagatgtccgtgggacagggcgccaagctgacaatctctccagattacgcatatggagcaaccggacacccaggaatcatcccaccccacgccaccctggtgttcgacgtggagctgctggagctggagtga

SEQ ID NO: 1839 - DNA, 603 bp, Artificial Sequence; identical to SEQ ID NO: 1795
  Description of Artificial Sequence: Synthetic Promoter

SEQ ID NO: 1840 - DNA, 1339 bp, Artificial Sequence; identical to SEQ ID NO: 1796
  Description of Artificial Sequence: Synthetic Promoter

SEQ ID NO: 1841 - DNA, 1335 bp, Artificial Sequence; identical to SEQ ID NO: 1798
  Description of Artificial Sequence: Synthetic Promoter

SEQ ID NO: 1842 - DNA, 399 bp, Artificial Sequence; identical to SEQ ID NO: 1797
  Description of Artificial Sequence: Synthetic Promoter

SEQ ID NO: 1843 - DNA, 1335 bp, Artificial Sequence; identical to SEQ ID NO: 1798
  Description of Artificial Sequence: Synthetic promoter

SEQ ID NO: 1844 - protein, 20 aa, Homo sapiens
MYRMQLLSCIALSLALVTNS

SEQ ID NO: 1845 - DNA, 60 bp, Homo sapiens; identical to SEQ ID NO: 1776

SEQ ID NO: 1846 - DNA, 60 bp, Artificial Sequence; identical to SEQ ID NO: 1777
  Description of Artificial Sequence: Synthetic signal sequence

SEQ ID NO: 1847 - DNA, 60 bp, Artificial Sequence; identical to SEQ ID NO: 1778
  Description of Artificial Sequence: Synthetic signal sequence

SEQ ID NO: 1848 - DNA, 60 bp, Artificial Sequence; identical to SEQ ID NO: 1779
  Description of Artificial Sequence: Synthetic signal sequence

SEQ ID NO: 1849 - protein, 18 aa, Homo sapiens
MDWTWILFLVAAATRVHS

SEQ ID NO: 1850 - DNA, 54 bp, Homo sapiens
atggactggacatggatactcttcctggtagcagccgccacacgagtgcacagc

SEQ ID NO: 1851 - DNA, 54 bp, Homo sapiens
atggactggacctggattctgtttctggtggccgctgccacaagagtgcacagc

SEQ ID NO: 1852 - DNA, 54 bp, Homo sapiens
atggattggacctggattctgtttctggtggccgctgccacaagagtgcacagc

SEQ ID NO: 1853 - protein, 6 aa, Artificial Sequence
  Description of Artificial Sequence: Synthetic linker
EFSTEF

SEQ ID NO: 1854 - DNA, 18 bp, Artificial Sequence
  Description of Artificial Sequence: Synthetic linker
gagttcagcaccgagttt

SEQ ID NO: 1855 - DNA, 18 bp, Artificial Sequence
  Description of Artificial Sequence: Synthetic linker
gagttctccaccgagttc

SEQ ID NO: 1856 - protein, 134 aa, Artificial Sequence
  Description of Artificial Sequence: Synthetic polypeptide
MYRMQLLSCIALSLALVTNSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1857 - DNA, 405 bp, Artificial Sequence
  Description of Artificial Sequence: Synthetic polynucleotide
atgtacaggatgcagctgctgagctgcatcgccctgagcctggccctggtgaccaacagcaactgggtgaacgtgatctccgacctgaagaagatcgaggacctgatccagtccatgcacatcgacgccaccctgtacaccgagagcgacgtgcaccctagctgcaaggtgaccgccatgaagtgcttcctgctggagctgcaggtgatcagcctggagagcggcgatgccagcatccacgacacagtggagaacctgatcatcctggccaacaacagcctgagcagcaacggcaatgtgaccgagagcggctgcaaggagtgcgaggagctggaggagaagaacatcaaggagttcctgcagtccttcgtgcacatcgtgcagatgttcatcaacaccagctaa

SEQ ID NO: 1858 - protein, 303 aa, Artificial Sequence
  Description of Artificial Sequence: Synthetic polypeptide
MYRMQLLSCIALSLALVTNSEFSTEFISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRGGSGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1859 - DNA, 912 bp, Artificial Sequence
  Description of Artificial Sequence: Synthetic polynucleotide
atgtacagaatgcagctgctgagctgcatcgccctgtccctcgccctggtgaccaactccgagttctccaccgagttcatctccctgatcgccgccctggccgtggattatgtgatcggcatggagaacgccatgccctggaatctgcccgccgacctggcctggttcaagaggaataccctgaacaagcccgtcatcatgggcaggcacacctgggaaagcatcggcagacccctgcccggcaggaagaacatcatcctgtccagccagcccggcaccgacgacagagtgacctgggtgaagagcgtggacgaagctatcgccgcttgcggcgacgtgcccgagatcatggtgatcggcggcggcagggtgatcgaacagttcctgcccaaggcccagaagctgtacctgacccacatcgatgccgaggtggaaggcgatacacacttccccgattacgaacctgacgactgggaaagcgtgttttccgaattccacgacgccgacgcccagaacagccacagctactgcttcgagatcctggaaagaaggggaggctccggcggaaactgggtcaacgtgatcagcgacctgaagaagatcgaggacctcatccagtccatgcacattgacgccaccctgtacaccgagtccgatgtgcaccctagctgcaaggtgaccgccatgaaatgcttcctgctggagctgcaggtcatctccttagaaagcggcgatgcctccatccacgacaccgtggagaacctgatcatcctggccaataactccctgagcagcaacggcaacgtgaccgagagcggctgcaaagagtgtgaagagctggaggagaagaacattaaggagttcctgcagagcttcgtgcacatcgtgcaaatgttcatcaacaccagctaa

SEQ ID NO: 1860 - protein, 143 aa, Artificial Sequence
  Description of Artificial Sequence: Synthetic polypeptide
MDWTWILFLVAAATRVHSYPYDVPDYANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGS

SEQ ID NO: 1861 - DNA, 432 bp, Artificial Sequence
  Description of Artificial Sequence: Synthetic polynucleotide
atggactggacatggatactcttcctggtagcagccgccacacgagtgcacagctacccatacgatgttccagattacgctaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttctggatcctga

SEQ ID NO: 1862 - protein, 389 aa, Artificial Sequence
  Description of Artificial Sequence: Synthetic polypeptide
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGSGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 1863 - DNA, 1170 bp, Artificial Sequence
  Description of Artificial Sequence: Synthetic polynucleotide
atggactggacatggatactcttcctggtagcagccgccacacgagtgcacagcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggatccggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 1864 - protein, 577 aa, Artificial Sequence
  Description of Artificial Sequence: Synthetic polypeptide
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKNDGSGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 1865 - DNA, 1734 bp, Artificial Sequence
  Description of Artificial Sequence: Synthetic polynucleotide
atggactggacatggatactcttcctggtagcagccgccacacgagtgcacagcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggttccgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgatggatccggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 1866 - DNA, 603 bp, Artificial Sequence; identical to SEQ ID NO: 1795
  Description of Artificial Sequence: Synthetic promoter

SEQ ID NO: 1867 - DNA, 1339 bp, Artificial Sequence; identical to SEQ ID NO: 1796
  Description of Artificial Sequence: Synthetic promoter

SEQ ID NO: 1868 - DNA, 1335 bp, Artificial Sequence; identical to SEQ ID NO: 1798
  Description of Artificial Sequence: Synthetic promoter

SEQ ID NO: 1869 - DNA, 399 bp, Artificial Sequence; identical to SEQ ID NO: 1797
  Description of Artificial Sequence: Synthetic promoter

SEQ ID NO: 1870 - skipped

SEQ ID NO: 1871 - protein, 20 aa, Homo sapiens
MYRMQLLSCIALSLALVTNS

SEQ ID NO: 1872 - DNA, 60 bp, Homo sapiens; identical to SEQ ID NO: 1776

SEQ ID NO: 1873 - DNA, 60 bp, Artificial Sequence; identical to SEQ ID NO: 1777
  Description of Artificial Sequence: Synthetic signal sequence

SEQ ID NO: 1874 - DNA, 60 bp, Artificial Sequence; identical to SEQ ID NO: 1778
  Description of Artificial Sequence: Synthetic signal sequence

SEQ ID NO: 1875 - DNA, 60 bp, Artificial Sequence; identical to SEQ ID NO: 1779
  Description of Artificial Sequence: Synthetic signal sequence

SEQ ID NO: 1876 - protein, 18 aa, Homo sapiens
MDWTWILFLVAAATRVHS

SEQ ID NO: 1877 - DNA, 54 bp, Homo sapiens; identical to SEQ ID NO: 1850

SEQ ID NO: 1878 - DNA, 54 bp, Artificial Sequence; identical to SEQ ID NO: 1851
  Description of Artificial Sequence: Synthetic signal sequence

SEQ ID NO: 1879 - DNA, 54 bp, Artificial Sequence; identical to SEQ ID NO: 1852
  Description of Artificial Sequence: Synthetic signal sequence

SEQ ID NO: 1880 - protein, 6 aa, Artificial Sequence
  Description of Artificial Sequence: Synthetic linker
EFSTEF

SEQ ID NO: 1881 - DNA, 18 bp, Artificial Sequence
  Description of Artificial Sequence: Synthetic linker
gagttcagcaccgagttt

SEQ ID NO: 1882 - DNA, 18 bp, Artificial Sequence
  Description of Artificial Sequence: Synthetic linker
gagttctccaccgagttc

SEQ ID NO: 1883 - protein, 5 aa, Artificial Sequence
  Description of Artificial Sequence: Synthetic linker
GGSGG

SEQ ID NO: 1884 - DNA, 15 bp, Artificial Sequence
  Description of Artificial Sequence: Synthetic linker
ggaggcagcggagga

SEQ ID NO: 1885 - DNA, 15 bp, Artificial Sequence
  Description of Artificial Sequence: Synthetic linker
ggaggctctggagga

SEQ ID NO: 1886 - DNA, 15 bp, Artificial Sequence
  Description of Artificial Sequence: Synthetic linker
ggaggctccggcgga

SEQ ID NO: 1887 - DNA, 15 bp, Artificial Sequence
  Description of Artificial Sequence: Synthetic linker
ggaggatccggaggc

SEQ ID NO: 1888 - DNA, 15 bp, Artificial Sequence
  Description of Artificial Sequence: Synthetic linker
ggaggatctggagga

SEQ ID NO: 1889 - protein, 9 aa, Artificial Sequence
  Description of Artificial Sequence: Synthetic HA Tag
YPYDVPDYA

SEQ ID NO: 1890 - DNA, 27 bp, Artificial Sequence
  Description of Artificial Sequence: Synthetic HA Tag
tacccatacgatgttccagattacgct

SEQ ID NO: 1891 - DNA, 27 bp, Artificial Sequence
  Description of Artificial Sequence: Synthetic HA Tag
tatccttacgatgtgcccgactatgct

SEQ ID NO: 1892 - DNA, 10 bp, Artificial Sequence
  Description of Artificial Sequence: Synthetic BamH1 site
  modified_base (7)..(10): a, c, t or g
ggatccnnnn

SEQ ID NO: 1893 - protein, 20 aa, Artificial Sequence
  Description of Artificial Sequence: Synthetic Cleavable peptide
GATNFSLLKQAGDVEENPGP

SEQ ID NO: 1894 - DNA, 60 bp, Artificial Sequence; identical to SEQ ID NO: 1806
  Description of Artificial Sequence: Synthetic Cleavable peptide

SEQ ID NO: 1895 - protein, 235 aa, Artificial Sequence; identical to SEQ ID NO: 1625
  Description of Artificial Sequence: Synthetic polypeptide

SEQ ID NO: 1896 - DNA, 708 bp, Artificial Sequence
  Description of Artificial Sequence: Synthetic polynucleotide
ttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 1897 - DNA, 345 bp, Homo sapiens; identical to SEQ ID NO: 168

SEQ ID NO: 1898 - DNA, 345 bp, Artificial Sequence; identical to SEQ ID NO: 1617
  Description of Artificial Sequence: Synthetic construct

SEQ ID NO: 1899 - DNA, 345 bp, Artificial Sequence; identical to SEQ ID NO: 1618
  Description of Artificial Sequence: Synthetic construct

SEQ ID NO: 1900 - DNA, 474 bp, Artificial Sequence; identical to SEQ ID NO: 1676
  Description of Artificial Sequence: Synthetic Destabilizing Domain (DD)

SEQ ID NO: 1901 - DNA, 342 bp, Artificial Sequence; identical to SEQ ID NO: 1620
  Description of Artificial Sequence: Synthetic construct

SEQ ID NO: 1902 - DNA, 342 bp, Artificial Sequence
  Description of Artificial Sequence: Synthetic construct
aactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 1903 - protein, 158 aa, Artificial Sequence; identical to SEQ ID NO: 1174
  Description of Artificial Sequence: Synthetic Destabilizing Domain (DD)

SEQ ID NO: 1904 - DNA, 474 bp, Artificial Sequence; identical to SEQ ID NO: 1676
  Description of Artificial Sequence: Synthetic Destabilizing Domain (DD)

SEQ ID NO: 1905 - DNA, 474 bp, Artificial Sequence; identical to SEQ ID NO: 1678
  Description of Artificial Sequence: Synthetic Destabilizing Domain (DD)

SEQ ID NO: 1906 - DNA, 477 bp, Artificial Sequence; identical to SEQ ID NO: 1677
  Description of Artificial Sequence: Synthetic Destabilizing Domain (DD)

SEQ ID NO: 1907 - protein, 186 aa, Artificial Sequence; identical to SEQ ID NO: 13
  Description of Artificial Sequence: Synthetic Destabilizing Domain (DD)

SEQ ID NO: 1908 - DNA, 558 bp, Artificial Sequence; identical to SEQ ID NO: 1685
  Description of Artificial Sequence: Synthetic Destabilizing Domain (DD)

SEQ ID NO: 1909 - protein, 134 aa, Artificial Sequence; identical to SEQ ID NO: 1856
  Description of Artificial Sequence: Synthetic polypeptide

SEQ ID NO: 1910 - DNA, 405 bp, Artificial Sequence; identical to SEQ ID NO: 1857
  Description of Artificial Sequence: Synthetic polynucleotide

SEQ ID NO: 1911 - protein, 303 aa, Artificial Sequence; identical to SEQ ID NO: 1858
  Description of Artificial Sequence: Synthetic polypeptide

SEQ ID NO: 1912 - DNA, 912 bp, Artificial Sequence; identical to SEQ ID NO: 1859
  Description of Artificial Sequence: Synthetic polynucleotide

SEQ ID NO: 1913 - protein, 143 aa, Artificial Sequence; identical to SEQ ID NO: 1860
  Description of Artificial Sequence: Synthetic polypeptide

SEQ ID NO: 1914 - DNA, 432 bp, Artificial Sequence; identical to SEQ ID NO: 1861
  Description of Artificial Sequence: Synthetic polynucleotide

SEQ ID NO: 1915 - protein, 389 aa, Artificial Sequence; identical to SEQ ID NO: 1862
  Description of Artificial Sequence: Synthetic polypeptide

SEQ ID NO: 1916 - DNA, 1170 bp, Artificial Sequence; identical to SEQ ID NO: 1863
  Description of Artificial Sequence: Synthetic polynucleotide

SEQ ID NO: 1917 - protein, 577 aa, Artificial Sequence; identical to SEQ ID NO: 1864
  Description of Artificial Sequence: Synthetic polypeptide

SEQ ID NO: 1918 - DNA, 1734 bp, Artificial Sequence; identical to SEQ ID NO: 1865
  Description of Artificial Sequence: Synthetic polynucleotide

SEQ ID NO: 1919 - protein, 30 aa, Homo sapiens
MAPRRARGCRTLGLPALLLLLLLRPPATRG

SEQ ID NO: 1920 - DNA, 90 bp, Artificial Sequence; identical to SEQ ID NO: 1724
  Description of Artificial Sequence: Synthetic construct

SEQ ID NO: 1921 - protein, 5 aa, Artificial Sequence
  Description of Artificial Sequence: Synthetic linker
SGGGS

SEQ ID NO: 1922 - DNA, 15 bp, Artificial Sequence
  Description of Artificial Sequence: Synthetic linker
tcaggtggcggtagt

SEQ ID NO: 1923 - DNA, 15 bp, Artificial Sequence
  Description of Artificial Sequence: Synthetic linker
agcggcggtggcagc

SEQ ID NO: 1924 - protein, 34 aa, Artificial Sequence
  Description of Artificial Sequence: Synthetic linker
SGGGSGGGGSGGGGSGGGGSGGGGSGGGGSGGGS

SEQ ID NO: 1925 - DNA, 102 bp, Artificial Sequence
  Description of Artificial Sequence: Synthetic linker
tctggtggcgggagtggaggaggtgggtccggagggggagggagcggtggtggaggttccggcggggggggtagtggaggcggagggtcaggtgggggcagc

SEQ ID NO: 1926 - protein, 20 aa, Artificial Sequence
  Description of Artificial Sequence: Synthetic linker
SGGGSGGGGSGGGGSGGGGS

SEQ ID NO: 1927 - DNA, 60 bp, Artificial Sequence
  Description of Artificial Sequence: Synthetic linker
agtggtggcgggtccggcggtggtggtagcgggggtggaggctcaggtggcggtggcagt

SEQ ID NO: 1928 - DNA, 10 bp, Artificial Sequence
  Description of Artificial Sequence: Synthetic linker
  modified_base (7)..(10): a, c, t or g
ggttccnnnn

SEQ ID NO: 1929 - DNA, 10 bp, Artificial Sequence
  Description of Artificial Sequence: Synthetic linker
  modified_base (7)..(10): a, c, t or g
agcggcnnnn

SEQ ID NO: 1930 - DNA, 10 bp, Artificial Sequence
  Description of Artificial Sequence: Synthetic linker
  modified_base (9)..(10): a, c, t or g
ggatccggnn

SEQ ID NO: 1931 - DNA, 10 bp, Artificial Sequence
  Description of Artificial Sequence: Synthetic linker
  modified_base (10)..(10): a, c, t or g
ggatccggtn

SEQ ID NO: 1932 - DNA, 28 bp, Artificial Sequence
  Description of Artificial Sequence: Synthetic spacer
tctagataatacgactcactagagatcc

SEQ ID NO: 1933 - DNA, 16 bp, Artificial Sequence
  Description of Artificial Sequence: Synthetic spacer
tatggccacaaccatg

SEQ ID NO: 1934 - DNA, 30 bp, Artificial Sequence
  Description of Artificial Sequence: Synthetic spacer
aatctagataatacgactcactagagatcc

SEQ ID NO: 1935 - DNA, 10 bp, Artificial Sequence
  Description of Artificial Sequence: Synthetic spacer
  modified_base (10)..(10): a, c, t or g
tcgcgaatgn

SEQ ID NO: 1936 - DNA, 10 bp, Artificial Sequence
  Description of Artificial Sequence: Synthetic spacer
  modified_base (6)..(10): a, c, t or g
tcgcannnnn

SEQ ID NO: 1937 - protein, 175 aa, Artificial Sequence; identical to SEQ ID NO: 725
  Description of Artificial Sequence: Synthetic construct

SEQ ID NO: 1938 - DNA, 525 bp, Artificial Sequence
  Description of Artificial Sequence: Synthetic construct
attacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacg

SEQ ID NO: 1939 - protein, 235 aa, Artificial Sequence
  Description of Artificial Sequence: Synthetic construct
MSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 1940 - DNA, 708 bp, Artificial Sequence
  Description of Artificial Sequence: Synthetic construct
atgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 1941 - protein, 8 aa, Artificial Sequence
  Description of Artificial Sequence: Synthetic FLAG sequence
DYKDDDDK

SEQ ID NO: 1942 - DNA, 10 bp, Artificial Sequence
  Description of Artificial Sequence: Synthetic BamH1 site
  modified_base (7)..(10): a, c, t or g
ggatccnnnn

SEQ ID NO: 1943 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgaggagaatgat

SEQ ID NO: 1944 - DNA, 561 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccaggatacccaggtgttctctctgatgtccaggaggagaaaggctttaagtacaaatttgaagtatatgagaagaatgattga

SEQ ID NO: 1945 - DNA, 561 bp, Artificial Sequence; identical to SEQ ID NO: 1944
  Description of Artificial Sequence: Synthetic destabilizing domain (DD)

SEQ ID NO: 1946 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgtatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 1947 - DNA, 558 bp, Artificial Sequence; identical to SEQ ID NO: 126
  Description of Artificial Sequence: Synthetic destabilizing domain (DD)

SEQ ID NO: 1948 - DNA, 558 bp, Artificial Sequence
  Description of Artificial Sequence: Synthetic destabilizing domain (DD)
gttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggcagacttaaactatttgtgacaaggatcatgcaagactttggaagtgacacgttttttccagaaattgatttggagaaatataaacttctgccagaatacccaggtgttctctctgatgtccaggaggagaaaggcattaagtacaaatttgaagtatatgagaagaatgat

SEQ ID NO: 1949 - protein, 555 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGISLIAALAVDHVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYKPDDWESVFSEFHDADAQNSHSYCFEILERR

SEQ ID NO: 1950 - DNA, 1608 bp, Artificial Sequence
  Description of Artificial Sequence: Synthetic polynucleotide
gtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagcggcatctctctgattgcggcgctggcagttgaccacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacaaaccggatgattgggagagcgtattctccgaattccatgatgcggatgcgcaaaactctcattcttactgttttgaaatcctggaacgtcgttga

SEQ ID NO: 1951 - protein, 504 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 1952 - DNA, 1515 bp, Artificial Sequence
  Description of Artificial Sequence: Synthetic polynucleotide
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagcggcggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggagtga

SEQ ID NO: 1953 - protein, 395 aa, Artificial Sequence [sequence omitted]

SEQ ID NO: 1954 - DNA, 1188 bp, Artificial Sequence; identical to SEQ ID NO: 169
  Description of Artificial Sequence: Synthetic polynucleotide

SEQ ID NO: 1955 - protein, 555 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1956 - DNA, 1668 bp, Artificial Sequence
  Description of Artificial Sequence: Synthetic polynucleotide
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 1957 - protein, 583 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEFMNHPGHLKLFVTRIMQDFESDTFFPEIDLEKYKLLPEYPGVLSDVQEEKGIKYKFEVYEKND

SEQ ID NO: 1958 - DNA, 1752 bp, Artificial Sequence; identical to SEQ ID NO: 170
  Description of Artificial Sequence: Synthetic polynucleotide

SEQ ID NO: 1959 - protein, 583 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGVGSLNCIVAVSQNMGIGKNGDLPWPPLRNEFRYFFRMTTTSSVEGKQNLVIMGKKTWFSIPEKFRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1960 - DNA, 1752 bp, Artificial Sequence; identical to SEQ ID NO: 171
  Description of Artificial Sequence: Synthetic polynucleotide

SEQ ID NO: 1961 - protein, 583 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEEND

SEQ ID NO: 1962 - DNA, 1752 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgaggagaatgattga

SEQ ID NO: 1963 - protein, 583 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPGYPGVLSDVQEEKGFKYKFEVYEKND

SEQ ID NO: 1964 - DNA, 1752 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccaggatacccaggtgttctctctgatgtccaggaggagaaaggctttaagtacaaatttgaagtatatgagaagaatgattga

SEQ ID NO: 1965 - protein, 583 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMYHPGHLKLFVTRIMQDFESDTFFPEIDLEKYKLLPEYPGVLSDVQEEKGIKYKFEVYEKND

SEQ ID NO: 1966 - DNA, 1752 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgtatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 1967 - protein, 404 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1968 - DNA, 1215 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 1969 - protein, 403 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGGSGGGGSGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1970 - DNA, 1212 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttctggtggcgggagtggaggaggtgggtccggagggggagggagcggtggtggaggttccggcggggggggtagtggaggcggagggtcaggtgggggcagcattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 1971 - protein, 403 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSYPYDVPDYASGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1972 - DNA, 1212 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttctagtggtggcgggtccggcggtggtggtagcgggggtggaggctcaggtggcggtggcagttatccttacgatgtgcccgactatgcttcaggcggggggagtattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 1973 - protein, 371 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1974 - DNA, 1116 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttctagtggtattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 1975 - protein, 407 aa, Artificial Sequence
  Description of Artificial Sequence: Synthetic construct
MAPRRARGCRTLGLPALLLLLLLRPPATRGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1976 - DNA, 1224 bp, Artificial Sequence
  Description of Artificial Sequence: Synthetic construct
atggccccgcggcgggcgcgcggctgccggaccctcggtctcccggcgctgctactgctgctgctgctccggccgccggcgacgcggggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttccggtggaggtagcggtggagggggttctggtggaggaggttctggaggtggaggttctggcggtgggtccttgcaaatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatga

SEQ ID NO: 1977 - protein, 397 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGS

SEQ ID NO: 1978 - DNA, 1194 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatcctga

SEQ ID NO: 1979 - protein, 555 aa, Artificial Sequence; identical to SEQ ID NO: 1955
  Description of Artificial Sequence: Synthetic construct

SEQ ID NO: 1980 - DNA, 1668 bp, Artificial Sequence
  Description of Artificial Sequence: Synthetic construct
atggactggacctggattctgtttctggtggccgctgccacaagagtgcacagcaattgggtcaacgtgatcagcgacctgaagaagatcgaggacctgatccagagcatgcacatcgacgccacactgtacaccgagtccgatgtgcaccctagctgcaaagtgaccgccatgaagtgctttctgctggaactgcaagtgatcagcctggaaagcggcgacgccagcatccacgataccgtggaaaatctgatcatcctggccaacaacagcctgagcagcaacggcaatgtgaccgagagcggctgcaaagagtgcgaggaactggaagagaagaacatcaaagagttcctccagagcttcgtccacatcgtgcagatgttcatcaacaccagctctggcggaggaagcggaggcggaggatctggtggtggtggatctggcggcggtggtagtggcggaggttctctgcaaatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagatcccgctctggttcaccagaggcctgctcctccatctacagtgacaacagctggcgtgacccctcagcctgagtctctgtctccatctggaaaagagcctgccgccagctctcccagctctaacaatactgctgccaccacagccgccatcgtgcctggatctcagctgatgcctagcaagagccctagcaccggcacaacagagatcagctctcacgagtctagccacggcaccccatctcagaccacagccaagaattgggagctgaccgcctctgcctctcatcagccacctggtgtttaccctcaaggccactctgataccaccgtggccatcagcacaagcacagtgctgctgtgtggactgtctgccgtgtctctgctggcctgctacctgaagtctagacagacacctcctctggccagcgtggaaatggaagccatggaagctctgcctgtgacatggggcaccagcagcagagatgaggacctcgagaattgcagccaccacctgagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttag

SEQ ID NO: 1981 - protein, 407 aa, Artificial Sequence; identical to SEQ ID NO: 1975
  Description of Artificial Sequence: Synthetic construct

SEQ ID NO: 1982 - DNA, 1224 bp, Artificial Sequence
  Description of Artificial Sequence: Synthetic construct
atggccccgcggcgggcgcgcggctgccggaccctcggtctcccggcgctgctactgctgctgctgctccggccgccggcgacgcggggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttccggggggggtagcgggggagggggttccggcgggggagggtctggagggggaggttccggcggggggtccttgcaaatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatga

SEQ ID NO: 1983 - DNA, 1188 bp, Artificial Sequence; identical to SEQ ID NO: 169
  Description of Artificial Sequence: Synthetic construct

SEQ ID NO: 1984 - protein, 573 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 1985 - DNA, 1722 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatccggaatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 1986 - protein, 414 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGS

SEQ ID NO: 1987 - DNA, 1245 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatcctga

SEQ ID NO: 1988 - protein, 601 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEEND

SEQ ID NO: 1989 - DNA, 1806 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatccggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgaggagaatgattga

SEQ ID NO: 1990 - protein, 601 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPGYPGVLSDVQEEKGFKYKFEVYEKND

SEQ ID NO: 1991 - DNA, 1806 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatccggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccaggatacccaggtgttctctctgatgtccaggaggagaaaggctttaagtacaaatttgaagtatatgagaagaatgattga

SEQ ID NO: 1992 - protein, 601 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGRLKLFVTRIMQDFGSDTFFPEIDLEKYKLLPEYPGVLSDVQEEKGIKYKFEVYEKND

SEQ ID NO: 1993 - DNA, 1806 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatccggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggcagacttaaactatttgtgacaaggatcatgcaagactttggaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 1994 - protein, 601 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGVGSLNCIVAVSQNMGVGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 1995 - DNA, 1806 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatccggtgttggttcgctaaactgcatcgtcgctgtgtcccagaacatgggcgtcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 1996 - protein, 601 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMYHPGHLKLFVTRIMQDFESDTFFPEIDLEKYKLLPEYPGVLSDVQEEKGIKYKFEVYEKND

SEQ ID NO: 1997 - DNA, 1806 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatccggtgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgtatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 1998 - protein, 601 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGVGSLNCIVAVSQNMGVGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 1999 - DNA, 1806 bp, Artificial Sequence
  Description of Artificial Sequence: Synthetic construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatccggtgttggttcgctaaactgcatcgtcgctgtgtcccagaacatgggcgtcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 2000 - protein, 681 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSRMDYKDDDDKDYKDDDDKDYKDDDDKSRGSGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 2001 - DNA, 2046 bp, Artificial Sequence
  Description of Artificial Sequence: Synthetic construct
atggattggacctggattctgtttctggtggccgctgccacaagagtgcacagcaactgggtgaatgtgatcagcgacctgaagaagatcgaggatctgatccagagcatgcacattgatgccaccctgtacacagaatctgatgtgcaccctagctgtaaagtgaccgccatgaagtgttttctgctggagctgcaggtgatttctctggaaagcggagatgcctctatccacgacacagtggagaatctgatcatcctggccaacaatagcctgagcagcaatggcaatgtgacagagtctggctgtaaggagtgtgaggagctggaggagaagaacatcaaggagtttctgcagagctttgtgcacatcgtgcagatgttcatcaatacaagctctggcggaggatctggaggaggcggatctggaggaggaggcagtggaggcggaggatctggcggaggatctctgcagattacatgccctcctccaatgtctgtggagcacgccgatatttgggtgaagtcctacagcctgtacagcagagagagatacatctgcaacagcggctttaagagaaaggccggcacctcttctctgacagagtgcgtgctgaataaggccacaaatgtggcccactggacaacacctagcctgaagtgcattagagatcctgccctggtccaccagaggcctgcccctccatctacagtgacaacagccggagtgacacctcagcctgaatctctgagcccttctggaaaagaacctgccgccagctctcctagctctaataataccgccgccacaacagccgccattgtgcctggatctcagctgatgcctagcaagtctcctagcacaggcacaacagagatcagcagccacgaatcttctcacggaacaccttctcagaccaccgccaagaattgggagctgacagcctctgcctctcaccagcctccaggagtgtatcctcagggccactctgatacaacagtggccatcagcacatctacagtgctgctgtgtggactgtctgccgtgtctctgctggcctgttacctgaagtctagacagacacctcctctggcctctgtggagatggaggccatggaagccctgcctgtgacatggggaacaagcagcagagatgaggacctggagaattgttctcaccacctgtcgcgaatggactacaaggacgatgacgacaaggattataaagatgatgatgataaagattataaagacgacgatgataagtcgcgaggatccggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 2002 - protein, 652 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 2003 - DNA, 1959 bp, Artificial Sequence
  Description of Artificial Sequence: Synthetic construct
atggattggacctggattctgtttctggtggccgctgccacaagagtgcacagcaactgggtgaatgtgatcagcgacctgaagaagatcgaggatctgatccagagcatgcacattgatgccaccctgtacacagaatctgatgtgcaccctagctgtaaagtgaccgccatgaagtgttttctgctggagctgcaggtgatttctctggaaagcggagatgcctctatccacgacacagtggagaatctgatcatcctggccaacaatagcctgagcagcaatggcaatgtgacagagtctggctgtaaggagtgtgaggagctggaggagaagaacatcaaggagtttctgcagagctttgtgcacatcgtgcagatgttcatcaatacaagctctggcggaggatctggaggaggcggatctggaggaggaggcagtggaggcggaggatctggcggaggatctctgcagattacatgccctcctccaatgtctgtggagcacgccgatatttgggtgaagtcctacagcctgtacagcagagagagatacatctgcaacagcggctttaagagaaaggccggcacctcttctctgacagagtgcgtgctgaataaggccacaaatgtggcccactggacaacacctagcctgaagtgcattagagatcctgccctggtccaccagaggcctgcccctccatctacagtgacaacagccggagtgacacctcagcctgaatctctgagcccttctggaaaagaacctgccgccagctctcctagctctaataataccgccgccacaacagccgccattgtgcctggatctcagctgatgcctagcaagtctcctagcacaggcacaacagagatcagcagccacgaatcttctcacggaacaccttctcagaccaccgccaagaattgggagctgacagcctctgcctctcaccagcctccaggagtgtatcctcagggccactctgatacaacagtggccatcagcacatctacagtgctgctgtgtggactgtctgccgtgtctctgctggcctgttacctgaagtctagacagacacctcctctggcctctgtggagatggaggccatggaagccctgcctgtgacatggggaacaagcagcagagatgaggacctggagaattgttctcaccacctgggatccggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 2004 - protein, 320 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGSVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVIKEAMNHPGHLKLFVTRIMQDFESDTFFPEIDLEKYKLLPEYPGVLSDVQEEKGIKYKFEVYEKND

SEQ ID NO: 2005 - protein, 14 aa, Artificial Sequence
  Description of Artificial Sequence: Synthetic construct
YDSLEIPPLSLPPP

SEQ ID NO: 2006 - protein, 43 aa, Artificial Sequence; identical to SEQ ID NO: 697
  Description of Artificial Sequence: Synthetic construct

SEQ ID NO: 2007 - protein, 102 aa, Artificial Sequence; identical to SEQ ID NO: 698
  Description of Artificial Sequence: Synthetic construct

SEQ ID NO: 2008 - protein, 41 aa, Artificial Sequence; identical to SEQ ID NO: 699
  Description of Artificial Sequence: Synthetic construct

SEQ ID NO: 2009 - protein, 24 aa, Artificial Sequence
  Description of Artificial Sequence: Synthetic construct
ARARRITWPSSRSSCASRCTWRAP

SEQ ID NO: 2010 - protein, 23 aa, Artificial Sequence
  Description of Artificial Sequence: Synthetic construct
TATSSRSRARARAAPTRAPRPPS

SEQ ID NO: 2011 - protein, 24 aa, Artificial Sequence
  Description of Artificial Sequence: Synthetic construct
PRVAPCPSPGTSCPLSSCTAPRPT

SEQ ID NO: 2012 - protein, 9 aa, Artificial Sequence
  Description of Artificial Sequence: Synthetic construct
STPPTSPTT

SEQ ID NO: 2013 - protein, 12 aa, Artificial Sequence
  Description of Artificial Sequence: Synthetic construct
SCPSPRASSGSA

SEQ ID NO: 2014 - protein, 7 aa, Artificial Sequence
  Description of Artificial Sequence: Synthetic construct
TSRTAAW

SEQ ID NO: 2015 - protein, 14 aa, Artificial Sequence
  Description of Artificial Sequence: Synthetic construct
PRTPPCRTASSSTR

SEQ ID NO: 2016 - protein, 12 aa, Artificial Sequence
  Description of Artificial Sequence: Synthetic construct
SCAAPTSPPTAP

SEQ ID NO: 2017 - protein, 21 aa, Artificial Sequence
  Description of Artificial Sequence: Synthetic construct
CRRRPWAGRPPPSGCTPRTAP

SEQ ID NO: 2018 - protein, 7 aa, Artificial Sequence
  Description of Artificial Sequence: Synthetic construct
RARSSRG

SEQ ID NO: 2019 - protein, 64 aa, Artificial Sequence; identical to SEQ ID NO: 710
  Description of Artificial Sequence: Synthetic construct

SEQ ID NO: 2020 - DNA, 2291 bp, Artificial Sequence
  Description of Artificial Sequence: Synthetic construct
atggactggacatggatactcttcctggtagcagccgccacacgagtgcacagcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggttccgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattgatctagataatacgactcactagagatcccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgatgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 2021 - protein, 320 aa, Artificial Sequence; identical to SEQ ID NO: 2004
  Description of Artificial Sequence: Synthetic construct

SEQ ID NO: 2022 - DNA, 963 bp, Artificial Sequence
  Description of Artificial Sequence: Synthetic construct
atggactggacatggatactcttcctggtagcagccgccacacgagtgcacagcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggttccgttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgttattaaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattga

SEQ ID NO: 2023 - protein, 235 aa, Artificial Sequence; identical to SEQ ID NO: 1939
  Description of Artificial Sequence: Synthetic construct

SEQ ID NO: 2024 - DNA, 708 bp, Artificial Sequence; identical to SEQ ID NO: 1940
  Description of Artificial Sequence: Synthetic construct

SEQ ID NO: 2025 - protein, 134 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGS

SEQ ID NO: 2026 - protein, 7 aa, Artificial Sequence
  Description of Artificial Sequence: Synthetic construct
NLDNTTH

SEQ ID NO: 2027 - protein, 19 aa, Artificial Sequence
  Description of Artificial Sequence: Synthetic construct
RSRPSPSPPPNVTGRSRLE

SEQ ID NO: 2028 - protein, 60 aa, Artificial Sequence
  Description of Artificial Sequence: Synthetic construct
GRCAFVYMLFSTILPSFGNVRARKPGPVFLTSIPRGLSPLAKGMQGLLNVVKEAVPLEAS

SEQ ID NO: 2029 - protein, 29 aa, Artificial Sequence
  Description of Artificial Sequence: Synthetic construct
RQTTSVATLCRQRNPPPGDRCLCGQKPRV

SEQ ID NO: 2030 - protein, 58 aa, Artificial Sequence
  Description of Artificial Sequence: Synthetic construct
DTPAKAAQPQCHVVSWIVVERVKWLSSSVFNKGLKDAQKVPHCMGSDLGPRCTCFTCV

SEQ ID NO: 2031 - protein, 18 aa, Artificial Sequence
  Description of Artificial Sequence: Synthetic construct
SRLKKRLGPPNHGDVVFL

SEQ ID NO: 2032 - protein, 12 aa, Artificial Sequence
  Description of Artificial Sequence: Synthetic construct
YGHNHDEQGRGG

SEQ ID NO: 2033 - protein, 171 aa, Artificial Sequence
  Description of Artificial Sequence: Synthetic construct
HGHHQGVHALQGAHGGLRERPRVRDRGRGRGPPLRGHPDRQAEGDQGWPPALRLGHPVPSVHVRLQGLREAPRRHPRLLEAVLPRGLQVGARDELRGRRRGDRDPGLLPAGRRVHLQGEAARHQLPLRRPRNAEEDHGLGGLLRADVPRGRRPEGRDQAEAEAEGRRPLRR

SEQ ID NO: 2034 - protein, 56 aa, Artificial Sequence
  Description of Artificial Sequence: Synthetic construct
GQDHLQGQEARAAARRLQRQHQVGHHLPQRGLHHRGTVRTRRGPPLHRRHGRAVQV

SEQ ID NO: 2035 - DNA, 1735 bp, Artificial Sequence
  Description of Artificial Sequence: Synthetic construct
atggactggacatggatactcttcctggtagcagccgccacacgagtgcacagcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggatcctgaaatctagataatacgactcactagagatcccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaaccatgatgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 2036 - protein, 134 aa, Artificial Sequence; identical to SEQ ID NO: 2025
  Description of Artificial Sequence: Synthetic construct

SEQ ID NO: 2037 - DNA, 405 bp, Artificial Sequence
  Description of Artificial Sequence: Synthetic construct
atggactggacatggatactcttcctggtagcagccgccacacgagtgcacagcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggatcctga

SEQ ID NO: 2038 - protein, 235 aa, Artificial Sequence; identical to SEQ ID NO: 1939
  Description of Artificial Sequence: Synthetic construct

SEQ ID NO: 2039 - DNA, 708 bp, Artificial Sequence; identical to SEQ ID NO: 1940
  Description of Artificial Sequence: Synthetic construct

SEQ ID NO: 2040 - protein, 30 aa, Artificial Sequence; identical to SEQ ID NO: 1919
  Description of Artificial Sequence: Synthetic signal sequence

SEQ ID NO: 2041 - DNA, 90 bp, Artificial Sequence; identical to SEQ ID NO: 1724
  Description of Artificial Sequence: Synthetic signal sequence

SEQ ID NO: 2042 - protein, 26 aa, Artificial Sequence
  Description of Artificial Sequence: Synthetic linker
SGGGSGGGGSGGGGSGGGGSGGGSLQ

SEQ ID NO: 2043 - DNA, 78 bp, Artificial Sequence; identical to SEQ ID NO: 1647
  Description of Artificial Sequence: Synthetic linker

SEQ ID NO: 2044 - DNA, 78 bp, Artificial Sequence; identical to SEQ ID NO: 1648
  Description of Artificial Sequence: Synthetic linker

SEQ ID NO: 2045 - DNA, 78 bp, Artificial Sequence; identical to SEQ ID NO: 1649
  Description of Artificial Sequence: Synthetic linker

SEQ ID NO: 2046 - DNA, 78 bp, Artificial Sequence; identical to SEQ ID NO: 1650
  Description of Artificial Sequence: Synthetic linker

SEQ ID NO: 2047 - DNA, 78 bp, Artificial Sequence; identical to SEQ ID NO: 1651
  Description of Artificial Sequence: Synthetic linker

SEQ ID NO: 2048 - DNA, 78 bp, Artificial Sequence; identical to SEQ ID NO: 1652
  Description of Artificial Sequence: Synthetic linker

SEQ ID NO: 2049 - protein, 5 aa, Artificial Sequence
  Description of Artificial Sequence: Synthetic linker
SGGGS

SEQ ID NO: 2050 - DNA, 15 bp, Artificial Sequence
  Description of Artificial Sequence: Synthetic linker
tcaggtggcggtagt

SEQ ID NO: 2051 - DNA, 15 bp, Artificial Sequence
  Description of Artificial Sequence: Synthetic linker
agcggcggtggcagc

SEQ ID NO: 2052 - DNA, 15 bp, Artificial Sequence
  Description of Artificial Sequence: Synthetic linker
tcaggcggggggagt

SEQ ID NO: 2053 - protein, 34 aa, Artificial Sequence; identical to SEQ ID NO: 1924
  Description of Artificial Sequence: Synthetic linker

SEQ ID NO: 2054 - DNA, 102 bp, Artificial Sequence; identical to SEQ ID NO: 1925
  Description of Artificial Sequence: Synthetic linker

SEQ ID NO: 2055 - protein, 20 aa, Artificial Sequence
  Description of Artificial Sequence: Synthetic linker
SGGGSGGGGSGGGGSGGGGS

SEQ ID NO: 2056 - DNA, 60 bp, Artificial Sequence; identical to SEQ ID NO: 1927
  Description of Artificial Sequence: Synthetic linker

SEQ ID NO: 2057 - DNA, 10 bp, Artificial Sequence
  Description of Artificial Sequence: Synthetic linker
  modified_base (7)..(10): a, c, t or g
ggttccnnnn

SEQ ID NO: 2058 - DNA, 10 bp, Artificial Sequence
  Description of Artificial Sequence: Synthetic linker
  modified_base (7)..(10): a, c, t or g
agcggcnnnn

SEQ ID NO: 2059 - DNA, 10 bp, Artificial Sequence
  Description of Artificial Sequence: Synthetic linker
  modified_base (10)..(10): a, c, t or g
ggatccggan

SEQ ID NO: 2060 - DNA, 10 bp, Artificial Sequence
  Description of Artificial Sequence: Synthetic linker
  modified_base (10)..(10): a, c, t or g
ggatccggtn

SEQ ID NO: 2061 - DNA, 28 bp, Artificial Sequence
  Description of Artificial Sequence: Synthetic spacer
tctagataatacgactcactagagatcc

SEQ ID NO: 2062 - DNA, 16 bp, Artificial Sequence
  Description of Artificial Sequence: Synthetic spacer
tatggccacaaccatg

SEQ ID NO: 2063 - DNA, 30 bp, Artificial Sequence; identical to SEQ ID NO: 1934
  Description of Artificial Sequence: Synthetic spacer

SEQ ID NO: 2064 - protein, 69 aa, Homo sapiens; identical to SEQ ID NO: 607

SEQ ID NO: 2065 - DNA, 207 bp, Homo sapiens; identical to SEQ ID NO: 1549

SEQ ID NO: 2066 - DNA, 714 bp, Homo sapiens; identical to SEQ ID NO: 1622

SEQ ID NO: 2067 - DNA, 711 bp, Artificial Sequence; identical to SEQ ID NO: 1623
  Description of Artificial Sequence: Synthetic construct

SEQ ID NO: 2068 - DNA, 711 bp, Artificial Sequence
  Description of Artificial Sequence: Synthetic construct
atcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccaccta

SEQ ID NO: 2069 - DNA, 711 bp, Artificial Sequence; identical to SEQ ID NO: 1624
  Description of Artificial Sequence: Synthetic construct

SEQ ID NO: 2070 - DNA, 711 bp, Artificial Sequence
  Description of Artificial Sequence: Synthetic construct
attacatgccctcctccaatgtctgtggagcacgccgatatttgggtgaagtcctacagcctgtacagcagagagagatacatctgcaacagcggctttaagagaaaggccggcacctcttctctgacagagtgcgtgctgaataaggccacaaatgtggcccactggacaacacctagcctgaagtgcattagagatcctgccctggtccaccagaggcctgcccctccatctacagtgacaacagccggagtgacacctcagcctgaatctctgagcccttctggaaaagaacctgccgccagctctcctagctctaataataccgccgccacaacagccgccattgtgcctggatctcagctgatgcctagcaagtctcctagcacaggcacaacagagatcagcagccacgaatcttctcacggaacaccttctcagaccaccgccaagaattgggagctgacagcctctgcctctcaccagcctccaggagtgtatcctcagggccactctgatacaacagtggccatcagcacatctacagtgctgctgtgtggactgtctgccgtgtctctgctggcctgttacctgaagtctagacagacacctcctctggcctctgtggagatggaggccatggaagccctgcctgtgacatggggaacaagcagcagagatgaggacctggagaattgttctcaccacctg

SEQ ID NO: 2071 - DNA, 525 bp, Artificial Sequence; identical to SEQ ID NO: 1938
  Description of Artificial Sequence: Synthetic construct

SEQ ID NO: 2072 - protein, 235 aa, Artificial Sequence; identical to SEQ ID NO: 1939
  Description of Artificial Sequence: Synthetic construct

SEQ ID NO: 2073 - DNA, 708 bp, Artificial Sequence; identical to SEQ ID NO: 1940
  Description of Artificial Sequence: Synthetic construct

SEQ ID NO: 2074 - protein, 8 aa, Artificial Sequence
  Description of Artificial Sequence: Synthetic Flag sequence
DYKDDDDK

SEQ ID NO: 2075 - DNA, 24 bp, Artificial Sequence
  Description of Artificial Sequence: Synthetic Flag sequence
gactacaaagacgatgacgacaag

SEQ ID NO: 2076 - DNA, 10 bp, Artificial Sequence
  Description of Artificial Sequence: Synthetic BamH1 site
  modified_base (7)..(10): a, c, t or g
ggatccnnnn

SEQ ID NO: 2077 - protein, 158 aa, Artificial Sequence; identical to SEQ ID NO: 1175
  Description of Artificial Sequence: Synthetic Destabilizing Domain (DD)

SEQ ID NO: 2078 - DNA, 477 bp, Artificial Sequence; identical to SEQ ID NO: 1682
  Description of Artificial Sequence: Synthetic Destabilizing Domain (DD)

SEQ ID NO: 2079 - DNA, 474 bp, Artificial Sequence; identical to SEQ ID NO: 1683
  Description of Artificial Sequence: Synthetic Destabilizing Domain (DD)

SEQ ID NO: 2080 - protein, 107 aa, Artificial Sequence; identical to SEQ ID NO: 1177
  Description of Artificial Sequence: Synthetic Destabilizing Domain (DD)

SEQ ID NO: 2081 - DNA, 324 bp, Artificial Sequence; identical to SEQ ID NO: 1669
  Description of Artificial Sequence: Synthetic Destabilizing Domain (DD)

SEQ ID NO: 2082 - DNA, 324 bp, Artificial Sequence; identical to SEQ ID NO: 1670
  Description of Artificial Sequence: Synthetic Destabilizing Domain (DD)

SEQ ID NO: 2083 - DNA, 324 bp, Artificial Sequence; identical to SEQ ID NO: 1671
  Description of Artificial Sequence: Synthetic Destabilizing Domain (DD)

SEQ ID NO: 2084 - DNA, 324 bp, Artificial Sequence; identical to SEQ ID NO: 1672
  Description of Artificial Sequence: Synthetic Destabilizing Domain (DD)

SEQ ID NO: 2085 - protein, 186 aa, Artificial Sequence; identical to SEQ ID NO: 41
  Description of Artificial Sequence: Synthetic Destabilizing Domain (DD)

SEQ ID NO: 2086 - DNA, 561 bp, Artificial Sequence; identical to SEQ ID NO: 77
  Description of Artificial Sequence: Synthetic Destabilizing Domain (DD)

SEQ ID NO: 2087 - DNA, 558 bp, Artificial Sequence; identical to SEQ ID NO: 1689
  Description of Artificial Sequence: Synthetic Destabilizing Domain (DD)

SEQ ID NO: 2088 - DNA, 561 bp, Artificial Sequence; identical to SEQ ID NO: 1688
  Description of Artificial Sequence: Synthetic Destabilizing Domain (DD)

SEQ ID NO: 2089 - protein, 186 aa, Artificial Sequence; identical to SEQ ID NO: 56
  Description of Artificial Sequence: Synthetic Destabilizing Domain (DD)

SEQ ID NO: 2090 - DNA, 561 bp, Artificial Sequence; identical to SEQ ID NO: 85
  Description of Artificial Sequence: Synthetic Destabilizing Domain (DD)

SEQ ID NO: 2091 - DNA, 558 bp, Artificial Sequence; identical to SEQ ID NO: 1695
  Description of Artificial Sequence: Synthetic Destabilizing Domain (DD)

SEQ ID NO: 2092 - DNA, 561 bp, Artificial Sequence; identical to SEQ ID NO: 1694
  Description of Artificial Sequence: Synthetic Destabilizing Domain (DD)

SEQ ID NO: 2093 - protein, 186 aa, Artificial Sequence; identical to SEQ ID NO: 1251
  Description of Artificial Sequence: Synthetic Destabilizing Domain (DD)

SEQ ID NO: 2094 - DNA, 558 bp, Artificial Sequence; identical to SEQ ID NO: 1943
  Description of Artificial Sequence: Synthetic Destabilizing Domain (DD)

SEQ ID NO: 2095 - protein, 186 aa, Artificial Sequence; identical to SEQ ID NO: 1250
  Description of Artificial Sequence: Synthetic Destabilizing Domain (DD)

SEQ ID NO: 2096 - DNA, 561 bp, Artificial Sequence; identical to SEQ ID NO: 1944
  Description of Artificial Sequence: Synthetic Destabilizing Domain (DD)

SEQ ID NO: 2097 - DNA, 561 bp, Artificial Sequence; identical to SEQ ID NO: 1944
  Description of Artificial Sequence: Synthetic Destabilizing Domain (DD)

SEQ ID NO: 2098 - protein, 186 aa, Artificial Sequence; identical to SEQ ID NO: 1254
  Description of Artificial Sequence: Synthetic Destabilizing Domain (DD)

SEQ ID NO: 2099 - DNA, 558 bp, Artificial Sequence; identical to SEQ ID NO: 1946
  Description of Artificial Sequence: Synthetic Destabilizing Domain (DD)

SEQ ID NO: 2100 - protein, 186 aa, Artificial Sequence; identical to SEQ ID NO: 1256
  Description of Artificial Sequence: Synthetic Destabilizing Domain (DD)

SEQ ID NO: 2101 - DNA, 558 bp, Artificial Sequence; identical to SEQ ID NO: 1820
  Description of Artificial Sequence: Synthetic Destabilizing Domain (DD)

SEQ ID NO: 2102 - protein, 186 aa, Artificial Sequence; identical to SEQ ID NO: 33
  Description of Artificial Sequence: Synthetic Destabilizing Domain (DD)

SEQ ID NO: 2103 - DNA, 558 bp, Artificial Sequence; identical to SEQ ID NO: 126
  Description of Artificial Sequence: Synthetic Destabilizing Domain (DD)

SEQ ID NO: 2104 - protein, 186 aa, Artificial Sequence; identical to SEQ ID NO: 1255
  Description of Artificial Sequence: Synthetic Destabilizing Domain (DD)

SEQ ID NO: 2105 - DNA, 558 bp, Artificial Sequence; identical to SEQ ID NO: 1948
  Description of Artificial Sequence: Synthetic Destabilizing Domain (DD)

SEQ ID NO: 2106 - protein, 555 aa, Artificial Sequence; identical to SEQ ID NO: 1949
  Description of Artificial Sequence: Synthetic polypeptide

SEQ ID NO: 2107 - DNA, 1668 bp, Artificial Sequence
  Description of Artificial Sequence: Synthetic polynucleotide
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagcggcatctctctgattgcggcgctggcagttgaccacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacaaaccggatgattgggagagcgtattctccgaattccatgatgcggatgcgcaaaactctcattcttactgttttgaaatcctggaacgtcgttga

SEQ ID NO: 2108 - protein, 504 aa, Artificial Sequence; identical to SEQ ID NO: 1951
  Description of Artificial Sequence: Synthetic polypeptide

SEQ ID NO: 2109 - DNA, 1515 bp, Artificial Sequence; identical to SEQ ID NO: 1952
  Description of Artificial Sequence: Synthetic polynucleotide

SEQ ID NO: 2110 - protein, 395 aa, Artificial Sequence [sequence omitted]

SEQ ID NO: 2111 - DNA, 1188 bp, Artificial Sequence; identical to SEQ ID NO: 169
  Description of Artificial Sequence: Synthetic polynucleotide

SEQ ID NO: 2112 - protein, 555 aa, Artificial Sequence; identical to SEQ ID NO: 1955
  Description of Artificial Sequence: Synthetic polypeptide

SEQ ID NO: 2113 - DNA, 1668 bp, Artificial Sequence; identical to SEQ ID NO: 1956
  Description of Artificial Sequence: Synthetic polynucleotide

SEQ ID NO: 2114 - protein, 583 aa, Artificial Sequence; identical to SEQ ID NO: 1957
  Description of Artificial Sequence: Synthetic polypeptide

SEQ ID NO: 2115 - DNA, 1752 bp, Artificial Sequence; identical to SEQ ID NO: 170
  Description of Artificial Sequence: Synthetic polynucleotide

SEQ ID NO: 2116 - protein, 583 aa, Artificial Sequence; identical to SEQ ID NO: 1959
  Description of Artificial Sequence: Synthetic polypeptide

SEQ ID NO: 2117 - DNA, 1752 bp, Artificial Sequence; identical to SEQ ID NO: 171
  Description of Artificial Sequence: Synthetic polynucleotide

SEQ ID NO: 2118 - protein, 583 aa, Artificial Sequence; identical to SEQ ID NO: 1961
  Description of Artificial Sequence: Synthetic construct

SEQ ID NO: 2119 - DNA, 1752 bp, Artificial Sequence; identical to SEQ ID NO: 1962
  Description of Artificial Sequence: Synthetic construct

SEQ ID NO: 2120 - protein, 583 aa, Artificial Sequence; identical to SEQ ID NO: 1963
  Description of Artificial Sequence: Synthetic construct

SEQ ID NO: 2121 - DNA, 1752 bp, Artificial Sequence; identical to SEQ ID NO: 1964
  Description of Artificial Sequence: Synthetic construct

SEQ ID NO: 2122 - protein, 583 aa, Artificial Sequence; identical to SEQ ID NO: 1965
  Description of Artificial Sequence: Synthetic construct

SEQ ID NO: 2123 - DNA, 1752 bp, Artificial Sequence; identical to SEQ ID NO: 1966
  Description of Artificial Sequence: Synthetic construct

SEQ ID NO: 2124 - protein, 404 aa, Artificial Sequence; identical to SEQ ID NO: 1967
  Description of Artificial Sequence: Synthetic construct

SEQ ID NO: 2125 - DNA, 1215 bp, Artificial Sequence; identical to SEQ ID NO: 1968
  Description of Artificial Sequence: Synthetic construct

SEQ ID NO: 2126 - protein, 403 aa, Artificial Sequence; identical to SEQ ID NO: 1969
  Description of Artificial Sequence: Synthetic construct

SEQ ID NO: 2127 - DNA, 1212 bp, Artificial Sequence; identical to SEQ ID NO: 1970
  Description of Artificial Sequence: Synthetic construct

SEQ ID NO: 2128 - protein, 403 aa, Artificial Sequence; identical to SEQ ID NO: 1971
  Description of Artificial Sequence: Synthetic construct

SEQ ID NO: 2129 - DNA, 1212 bp, Artificial Sequence; identical to SEQ ID NO: 1972
  Description of Artificial Sequence: Synthetic construct

SEQ ID NO: 2130 - protein, 371 aa, Artificial Sequence; identical to SEQ ID NO: 1973
  Description of Artificial Sequence: Synthetic construct

SEQ ID NO: 2131 - DNA, 1116 bp, Artificial Sequence; identical to SEQ ID NO: 1974
  Description of Artificial Sequence: Synthetic construct

SEQ ID NO: 2132 - protein, 407 aa, Artificial Sequence; identical to SEQ ID NO: 1975
  Description of Artificial Sequence: Synthetic construct

SEQ ID NO: 2133 - DNA, 1224 bp, Artificial Sequence; identical to SEQ ID NO: 1976
  Description of Artificial Sequence: Synthetic construct

SEQ ID NO: 2134 - protein, 397 aa, Artificial Sequence; identical to SEQ ID NO: 1977
  Description of Artificial Sequence: Synthetic construct

SEQ ID NO: 2135 - DNA, 1194 bp, Artificial Sequence; identical to SEQ ID NO: 1978
  Description of Artificial Sequence: Synthetic construct

SEQ ID NO: 2136 - protein, 555 aa, Artificial Sequence; identical to SEQ ID NO: 1955
  Description of Artificial Sequence: Synthetic construct

SEQ ID NO: 2137 - DNA, 1668 bp, Artificial Sequence; identical to SEQ ID NO: 1980
  Description of Artificial Sequence: Synthetic construct

SEQ ID NO: 2138 - protein, 407 aa, Artificial Sequence; identical to SEQ ID NO: 1975
  Description of Artificial Sequence: Synthetic construct

SEQ ID NO: 2139 - DNA, 1224 bp, Artificial Sequence; identical to SEQ ID NO: 1976
  Description of Artificial Sequence: Synthetic construct

SEQ ID NO: 2140 - protein, 371 aa, Artificial Sequence
  Description of Artificial Sequence: Synthetic construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 2141 - DNA, 1116 bp, Artificial Sequence
  Description of Artificial Sequence: Synthetic construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttctggatccattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgtga

SEQ ID NO: 2142 - DNA, 1224 bp, Artificial Sequence; identical to SEQ ID NO: 1982
  Description of Artificial Sequence: Synthetic construct

SEQ ID NO: 2143 - DNA, 1128 bp, Artificial Sequence
  Description of Artificial Sequence: Synthetic construct
atggactggacctggattctgtttctggtggccgctgccacaagagtgcacagcaattgggtcaacgtgatcagcgacctgaagaagatcgaggacctgatccagagcatgcacatcgacgccacactgtacaccgagtccgatgtgcaccctagctgcaaagtgaccgccatgaagtgctttctgctggaactgcaagtgatcagcctggaaagcggcgacgccagcatccacgataccgtggaaaatctgatcatcctggccaacaacagcctgagcagcaacggcaatgtgaccgagagcggctgcaaagagtgcgaggaactggaagagaagaacatcaaagagttcctccagagcttcgtccacatcgtgcagatgttcatcaacaccagctctggcggaggaagcggaggcggaggatctggtggtggtggatctggcggcggtggtagtggcggaggttctctgcaaatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagatcccgctctggttcaccagaggcctgctcctccatctacagtgacaacagctggcgtgacccctcagcctgagtctctgtctccatctggaaaagagcctgccgccagctctcccagctctaacaatactgctgccaccacagccgccatcgtgcctggatctcagctgatgcctagcaagagccctagcaccggcacaacagagatcagctctcacgagtctagccacggcaccccatctcagaccacagccaagaattgggagctgaccgcctctgcctctcatcagccacctggtgtttaccctcaaggccactctgataccaccgtggccatcagcacaagcacagtgctgctgtgtggactgtctgccgtgtctctgctggcctgctacctgaagtctagacagacacctcctctggccagcgtggaaatggaagccatggaagctctgcct

SEQ ID NO: 2144 - protein, 573 aa, Artificial Sequence; identical to SEQ ID NO: 1984
  Description of Artificial Sequence: Synthetic construct

SEQ ID NO: 2145 - DNA, 1722 bp, Artificial Sequence; identical to SEQ ID NO: 1985
  Description of Artificial Sequence: Synthetic construct

SEQ ID NO: 2146 - protein, 414 aa, Artificial Sequence; identical to SEQ ID NO: 1986
  Description of Artificial Sequence: Synthetic construct

SEQ ID NO: 2147 - DNA, 1245 bp, Artificial Sequence; identical to SEQ ID NO: 1987
  Description of Artificial Sequence: Synthetic construct

SEQ ID NO: 2148 - protein, 600 aa, Artificial Sequence
  Description of Artificial Sequence: Synthetic construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEEN

SEQ ID NO: 2149 - DNA, 1806 bp, Artificial Sequence; identical to SEQ ID NO: 1989
  Description of Artificial Sequence: Synthetic construct

SEQ ID NO: 2150 - protein, 601 aa, Artificial Sequence; identical to SEQ ID NO: 1990
  Description of Artificial Sequence: Synthetic construct

SEQ ID NO: 2151 - DNA, 1806 bp, Artificial Sequence; identical to SEQ ID NO: 1991
  Description of Artificial Sequence: Synthetic construct

SEQ ID NO: 2152 - protein, 601 aa, Artificial Sequence; identical to SEQ ID NO: 1992
  Description of Artificial Sequence: Synthetic construct

SEQ ID NO: 2153 - DNA, 1806 bp, Artificial Sequence; identical to SEQ ID NO: 1993
  Description of Artificial Sequence: Synthetic construct

SEQ ID NO: 2154 - protein, 601 aa, Artificial Sequence; identical to SEQ ID NO: 1994
  Description of Artificial Sequence: Synthetic construct

SEQ ID NO: 2155 - DNA, 1806 bp, Artificial Sequence; identical to SEQ ID NO: 1995
  Description of Artificial Sequence: Synthetic construct

SEQ ID NO: 2156 - protein, 601 aa, Artificial Sequence; identical to SEQ ID NO: 1996
  Description of Artificial Sequence: Synthetic construct

SEQ ID NO: 2157 - DNA, 1806 bp, Artificial Sequence; identical to SEQ ID NO: 1997
  Description of Artificial Sequence: Synthetic construct

SEQ ID NO: 2158 - protein, 601 aa, Artificial Sequence; identical to SEQ ID NO: 1998
  Description of Artificial Sequence: Synthetic construct

SEQ ID NO: 2159 - DNA, 1806 bp, Artificial Sequence; identical to SEQ ID NO: 1999
  Description of Artificial Sequence: Synthetic construct

SEQ ID NO: 2160 - protein, 681 aa, Artificial Sequence; identical to SEQ ID NO: 2000
  Description of Artificial Sequence: Synthetic construct

SEQ ID NO: 2161 - DNA, 2046 bp, Artificial Sequence; identical to SEQ ID NO: 2001
  Description of Artificial Sequence: Synthetic construct

SEQ ID NO: 2162 - protein, 652 aa, Artificial Sequence; identical to SEQ ID NO: 2002
  Description of Artificial Sequence: Synthetic construct

SEQ ID NO: 2163 - DNA, 1959 bp, Artificial Sequence; identical to SEQ ID NO: 2003
  Description of Artificial Sequence: Synthetic construct

SEQ ID NO: 2164 - protein, 320 aa, Artificial Sequence; identical to SEQ ID NO: 2004
  Description of Artificial Sequence: Synthetic construct

SEQ ID NO: 2165 - protein, 14 aa, Artificial Sequence
  Description of Artificial Sequence: Synthetic construct
YDSLEIPPLSLPPP

SEQ ID NO: 2166 - protein, 43 aa, Artificial Sequence; identical to SEQ ID NO: 697
  Description of Artificial Sequence: Synthetic construct

SEQ ID NO: 2167 - protein, 102 aa, Artificial Sequence; identical to SEQ ID NO: 698
  Description of Artificial Sequence: Synthetic construct

SEQ ID NO: 2168 - protein, 41 aa, Artificial Sequence; identical to SEQ ID NO: 699
  Description of Artificial Sequence: Synthetic construct

SEQ ID NO: 2169 - protein, 24 aa, Artificial Sequence
  Description of Artificial Sequence: Synthetic construct
ARARRITWPSSRSSCASRCTWRAP

SEQ ID NO: 2170 - protein, 23 aa, Artificial Sequence
  Description of Artificial Sequence: Synthetic construct
TATSSRSRARARAAPTRAPRPPS

SEQ ID NO: 2171 - protein, 24 aa, Artificial Sequence
  Description of Artificial Sequence: Synthetic construct
PRVAPCPSPGTSCPLSSCTAPRPT

SEQ ID NO: 2172 - protein, 9 aa, Artificial Sequence
  Description of Artificial Sequence: Synthetic construct
STPPTSPTT

SEQ ID NO: 2173 - protein, 12 aa, Artificial Sequence
  Description of Artificial Sequence: Synthetic construct
SCPSPRASSGSA

SEQ ID NO: 2174 - protein, 7 aa, Artificial Sequence
  Description of Artificial Sequence: Synthetic construct
TSRTAAW

SEQ ID NO: 2175 - protein, 14 aa, Artificial Sequence
  Description of Artificial Sequence: Synthetic construct
PRTPPCRTASSSTR

SEQ ID NO: 2176 - protein, 12 aa, Artificial Sequence
  Description of Artificial Sequence: Synthetic construct
SCAAPTSPPTAP

SEQ ID NO: 2177 - protein, 21 aa, Artificial Sequence
  Description of Artificial Sequence: Synthetic construct
CRRRPWAGRPPPSGCTPRTAP

SEQ ID NO: 2178 - protein, 7 aa, Artificial Sequence
  Description of Artificial Sequence: Synthetic construct
RARSSRG

SEQ ID NO: 2179 - protein, 64 aa, Artificial Sequence; identical to SEQ ID NO: 710
  Description of Artificial Sequence: Synthetic construct

SEQ ID NO: 2180 - DNA, 2291 bp, Artificial Sequence; identical to SEQ ID NO: 2020
  Description of Artificial Sequence: Synthetic construct

SEQ ID NO: 2181 - DNA, 2291 bp, Artificial Sequence; identical to SEQ ID NO: 2020
  Description of Artificial Sequence: Synthetic construct

SEQ ID NO: 2182 - protein, 320 aa, Artificial Sequence; identical to SEQ ID NO: 2004
  Description of Artificial Sequence: Synthetic construct

SEQ ID NO: 2183 - DNA, 963 bp, Artificial Sequence; identical to SEQ ID NO: 2022
  Description of Artificial Sequence: Synthetic construct

SEQ ID NO: 2184 - protein, 235 aa, Artificial Sequence; identical to SEQ ID NO: 1939
  Description of Artificial Sequence: Synthetic construct

SEQ ID NO: 2185 - DNA, 708 bp, Artificial Sequence; identical to SEQ ID NO: 1940
  Description of Artificial Sequence: Synthetic construct

SEQ ID NO: 2186 - protein, 134 aa, Artificial Sequence; identical to SEQ ID NO: 2025
  Description of Artificial Sequence: Synthetic construct

SEQ ID NO: 2187 - protein, 7 aa, Artificial Sequence
  Description of Artificial Sequence: Synthetic construct
NLDNTTH

SEQ ID NO: 2188 - protein, 19 aa, Artificial Sequence
  Description of Artificial Sequence: Synthetic construct
RSRPSPSPPPNVTGRSRLE

SEQ ID NO: 2189 - protein, 60 aa, Artificial Sequence; identical to SEQ ID NO: 2028
  Description of Artificial Sequence: Synthetic construct

SEQ ID NO: 2190 - protein, 29 aa, Artificial Sequence
  Description of Artificial Sequence: Synthetic construct
RQTTSVATLCRQRNPPPGDRCLCGQKPRV

SEQ ID NO: 2191 - protein, 58 aa, Artificial Sequence; identical to SEQ ID NO: 2030
  Description of Artificial Sequence: Synthetic construct

SEQ ID NO: 2192 - protein, 18 aa, Artificial Sequence
  Description of Artificial Sequence: Synthetic construct
SRLKKRLGPPNHGDVVFL

SEQ ID NO: 2193 - protein, 12 aa, Artificial Sequence
  Description of Artificial Sequence: Synthetic construct
YGHNHDEQGRGG

SEQ ID NO: 2194 - protein, 171 aa, Artificial Sequence; identical to SEQ ID NO: 2033
  Description of Artificial Sequence: Synthetic construct

SEQ ID NO: 2195 - protein, 56 aa, Artificial Sequence; identical to SEQ ID NO: 2034
  Description of Artificial Sequence: Synthetic construct

SEQ ID NO: 2196 - DNA, 1735 bp, Artificial Sequence; identical to SEQ ID NO: 2035
  Description of Artificial Sequence: Synthetic construct

SEQ ID NO: 2197 - protein, 134 aa, Artificial Sequence; identical to SEQ ID NO: 2025
  Description of Artificial Sequence: Synthetic construct

SEQ ID NO: 2198 - DNA, 405 bp, Artificial Sequence; identical to SEQ ID NO: 2037
  Description of Artificial Sequence: Synthetic construct

SEQ ID NO: 2199 - protein, 20 aa, Homo sapiens
MYRMQLLSCIALSLALVTNS

SEQ ID NO: 2200 - DNA, 60 bp, Homo sapiens; identical to SEQ ID NO: 1777

SEQ ID NO: 2201 - DNA, 60 bp, Artificial Sequence; identical to SEQ ID NO: 1776
  Description of Artificial Sequence: Synthetic signal sequence

SEQ ID NO: 2202 - DNA, 60 bp, Artificial Sequence; identical to SEQ ID NO: 1778
  Description of Artificial Sequence: Synthetic signal sequence

SEQ ID NO: 2203 - DNA, 60 bp, Artificial Sequence; identical to SEQ ID NO: 1779
  Description of Artificial Sequence: Synthetic signal sequence

SEQ ID NO: 2204 - protein, 18 aa, Homo sapiens
MDWTWILFLVAAATRVHS

SEQ ID NO: 2205 - DNA, 54 bp, Homo sapiens; identical to SEQ ID NO: 1850

SEQ ID NO: 2206 - protein, 114 aa, Homo sapiens; identical to SEQ ID NO: 718

SEQ ID NO: 2207 - DNA, 345 bp, Homo sapiens; identical to SEQ ID NO: 168

SEQ ID NO: 2208 - DNA, 342 bp, Artificial Sequence; identical to SEQ ID NO: 1619
  Description of Artificial Sequence: Synthetic construct

SEQ ID NO: 2209 - DNA, 345 bp, Artificial Sequence; identical to SEQ ID NO: 1617
  Description of Artificial Sequence: Synthetic construct

SEQ ID NO: 2210 - DNA, 345 bp, Artificial Sequence; identical to SEQ ID NO: 1618
  Description of Artificial Sequence: Synthetic construct

SEQ ID NO: 2211 - protein, 237 aa, Homo sapiens; identical to SEQ ID NO: 724

SEQ ID NO: 2212 - DNA, 714 bp, Homo sapiens; identical to SEQ ID NO: 1622

SEQ ID NO: 2213 - DNA, 711 bp, Artificial Sequence; identical to SEQ ID NO: 1623
  Description of Artificial Sequence: Synthetic construct

SEQ ID NO: 2214 - protein, 26 aa, Artificial Sequence
  Description of Artificial Sequence: Synthetic linker
SGGGSGGGGSGGGGSGGGGSGGGSLQ

SEQ ID NO: 2215 - DNA, 78 bp, Artificial Sequence; identical to SEQ ID NO: 1647
  Description of Artificial Sequence: Synthetic linker

SEQ ID NO: 2216 - protein, 395 aa, Artificial Sequence [sequence omitted]

SEQ ID NO: 2217 - protein, 583 aa, Artificial Sequence; identical to SEQ ID NO: 1957
  Description of Artificial Sequence: Synthetic polypeptide

SEQ ID NO: 2218 - protein, 583 aa, Artificial Sequence; identical to SEQ ID NO: 1959
  Description of Artificial Sequence: Synthetic polypeptide

SEQ ID NO: 2219 - protein, 22 aa, Homo sapiens
MCHQQLVISWFSLVFLASPLVA

SEQ ID NO: 2220 - DNA, 66 bp, Homo sapiens; identical to SEQ ID NO: 1580

SEQ ID NO: 2221 - DNA, 66 bp, Artificial Sequence; identical to SEQ ID NO: 1581
  Description of Artificial Sequence: Synthetic signal sequence

SEQ ID NO: 2222 - DNA, 66 bp, Artificial Sequence; identical to SEQ ID NO: 1582
  Description of Artificial Sequence: Synthetic signal sequence

SEQ ID NO: 2223 - DNA, 66 bp, Artificial Sequence; identical to SEQ ID NO: 1583
  Description of Artificial Sequence: Synthetic signal sequence

SEQ ID NO: 2224 - DNA, 66 bp, Artificial Sequence; identical to SEQ ID NO: 1584
  Description of Artificial Sequence: Synthetic signal sequence

SEQ ID NO: 2225 - DNA, 66 bp, Artificial Sequence; identical to SEQ ID NO: 1585
  Description of Artificial Sequence: Synthetic signal sequence

SEQ ID NO: 2226 - DNA, 66 bp, Artificial Sequence; identical to SEQ ID NO: 1586
  Description of Artificial Sequence: Synthetic signal sequence

SEQ ID NO: 2227 - DNA, 66 bp, Artificial Sequence; identical to SEQ ID NO: 1587
  Description of Artificial Sequence: Synthetic signal sequence

SEQ ID NO: 2228 - DNA, 66 bp, Artificial Sequence; identical to SEQ ID NO: 1588
  Description of Artificial Sequence: Synthetic signal sequence

SEQ ID NO: 2229 - protein, 15 aa, Artificial Sequence
  Description of Artificial Sequence: Synthetic linker
GGGGSGGGGSGGGGS

SEQ ID NO: 2230 - DNA, 45 bp, Artificial Sequence; identical to SEQ ID NO: 1636
  Description of Artificial Sequence: Synthetic linker

SEQ ID NO: 2231 - DNA, 45 bp, Artificial Sequence; identical to SEQ ID NO: 1637
  Description of Artificial Sequence: Synthetic linker

SEQ ID NO: 2232 - DNA, 45 bp, Artificial Sequence; identical to SEQ ID NO: 1638
  Description of Artificial Sequence: Synthetic linker

SEQ ID NO: 2233 - DNA, 45 bp, Artificial Sequence; identical to SEQ ID NO: 1639
  Description of Artificial Sequence: Synthetic linker

SEQ ID NO: 2234 - DNA, 45 bp, Artificial Sequence; identical to SEQ ID NO: 1640
  Description of Artificial Sequence: Synthetic linker

SEQ ID NO: 2235 - DNA, 45 bp, Artificial Sequence; identical to SEQ ID NO: 1641
  Description of Artificial Sequence: Synthetic linker

SEQ ID NO: 2236 - protein, 306 aa, Artificial Sequence; identical to SEQ ID NO: 734
  Description of Artificial Sequence: Synthetic cleavage site

SEQ ID NO: 2237 - DNA, 921 bp, Homo sapiens; identical to SEQ ID NO: 1593

SEQ ID NO: 2238 - DNA, 918 bp, Artificial Sequence; identical to SEQ ID NO: 1594
  Description of Artificial Sequence: Synthetic construct

SEQ ID NO: 2239 - DNA, 918 bp, Artificial Sequence; identical to SEQ ID NO: 1595
  Description of Artificial Sequence: Synthetic construct

SEQ ID NO: 2240 - DNA, 918 bp, Artificial Sequence; identical to SEQ ID NO: 1596
  Description of Artificial Sequence: Synthetic construct

SEQ ID NO: 2241 - DNA, 918 bp, Artificial Sequence; identical to SEQ ID NO: 1597
  Description of Artificial Sequence: Synthetic construct

SEQ ID NO: 2242 - DNA, 918 bp, Artificial Sequence; identical to SEQ ID NO: 1590
  Description of Artificial Sequence: Synthetic construct

SEQ ID NO: 2243 - DNA, 918 bp, Artificial Sequence; identical to SEQ ID NO: 1591
  Description of Artificial Sequence: Synthetic construct

SEQ ID NO: 2244 - DNA, 918 bp, Artificial Sequence; identical to SEQ ID NO: 1600
  Description of Artificial Sequence: Synthetic construct

SEQ ID NO: 2245 - DNA, 918 bp, Artificial Sequence; identical to SEQ ID NO: 1601
  Description of Artificial Sequence: Synthetic construct

SEQ ID NO: 2246 - DNA, 918 bp, Artificial Sequence; identical to SEQ ID NO: 1602
  Description of Artificial Sequence: Synthetic construct

SEQ ID NO: 2247 - protein, 197 aa, Homo sapiens; identical to SEQ ID NO: 735

SEQ ID NO: 2248 - DNA, 594 bp, Artificial Sequence; identical to SEQ ID NO: 1605
  Description of Artificial Sequence: Synthetic construct

SEQ ID NO: 2249 - DNA, 593 bp, Artificial Sequence
  Description of Artificial Sequence: Synthetic construct
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttg

SEQ ID NO: 2250 - DNA, 594 bp, Artificial Sequence; identical to SEQ ID NO: 1607
  Description of Artificial Sequence: Synthetic construct

SEQ ID NO: 2251 - DNA, 591 bp, Artificial Sequence; identical to SEQ ID NO: 1608
  Description of Artificial Sequence: Synthetic construct

SEQ ID NO: 2252 - DNA, 591 bp, Artificial Sequence; identical to SEQ ID NO: 1609
  Description of Artificial Sequence: Synthetic construct

SEQ ID NO: 2253 - DNA, 594 bp, Artificial Sequence; identical to SEQ ID NO: 1610
  Description of Artificial Sequence: Synthetic construct

SEQ ID NO: 2254 - DNA, 597 bp, Artificial Sequence; identical to SEQ ID NO: 1611
  Description of Artificial Sequence: Synthetic construct

SEQ ID NO: 2255 - DNA, 591 bp, Artificial Sequence; identical to SEQ ID NO: 1613
  Description of Artificial Sequence: Synthetic construct

SEQ ID NO: 2256 - protein, 193 aa, Homo sapiens
VATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 2257 - DNA, 582 bp, Homo sapiens
gtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 2258 - protein, 540 aa, Artificial Sequence; identical to SEQ ID NO: 1831
  Description of Artificial Sequence: Synthetic polypeptide

SEQ ID NO: 2259 - protein, 738 aa, Artificial Sequence; identical to SEQ ID NO: 1835
  Description of Artificial Sequence: Synthetic polypeptide

SEQ ID NO: 2260 - protein, 416 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 2261 - DNA, 1251 bp, Homo sapiens
atggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataa

SEQ ID NO: 2262 - protein, 415 aa, Homo sapiens; identical to SEQ ID NO: 744

SEQ ID NO: 2263 - DNA, 1248 bp, Artificial Sequence
  Description of Artificial Sequence: Synthetic construct
gacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagctga

SEQ ID NO: 2264 - protein, 5 aa, Artificial Sequence
  Description of Artificial Sequence: Synthetic linker
SGGGS

SEQ ID NO: 2265 - DNA, 15 bp, Artificial Sequence
  Description of Artificial Sequence: Synthetic linker
tcaggtggcggtagt

SEQ ID NO: 2266 - protein, 607 aa, Artificial Sequence; identical to SEQ ID NO: 1151
  Description of Artificial Sequence: Synthetic polypeptide

SEQ ID NO: 2267 - protein, 607 aa, Artificial Sequence; identical to SEQ ID NO: 1152
  Description of Artificial Sequence: Synthetic polypeptide

SEQ ID NO: 2268 - protein, 607 aa, Artificial Sequence; identical to SEQ ID NO: 1153
  Description of Artificial Sequence: Synthetic polypeptide

SEQ ID NO: 2269 - DNA, 1245 bp, Homo sapiens
gacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatca

SEQ ID NO: 2270 - DNA, 1245 bp, Artificial Sequence
  Description of Artificial Sequence: Synthetic Construct
gacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagc

SEQ ID NO: 2271 - protein, 285 aa, Homo sapiens
GVDGFGDVGALESLRGNADLAYILSMEPCGHCLIINNVNFCRESGLRTRTGSNIDCEKLRRRFSSLHFMVEVKGDLTAKKMVLALLELARQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 2272 - DNA, 855 bp, Homo sapiens
ggcgtggacgggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcggcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagc

SEQ ID NO: 2273 - protein, 13 aa, Artificial Sequence
  Description of Artificial Sequence: Synthetic linker
VDYPYDVPDYALD

SEQ ID NO: 2274 - DNA, 39 bp, Artificial Sequence
  Description of Artificial Sequence: Synthetic linker
gtcgactatccctacgatgttccggactacgcactggac

SEQ ID NO: 2275 - protein, 5 aa, Artificial Sequence
  Description of Artificial Sequence: Synthetic linker
SGGGS

SEQ ID NO: 2276 - DNA, 15 bp, Artificial Sequence
  Description of Artificial Sequence: Synthetic linker
tcaggtggcggtagt

SEQ ID NO: 2277 - DNA, 15 bp, Artificial Sequence
  Description of Artificial Sequence: Synthetic linker
agcggcggtggcagc

SEQ ID NO: 2278 - DNA, 15 bp, Artificial Sequence
  Description of Artificial Sequence: Synthetic linker
tcaggcggggggagt

SEQ ID NO: 2279 - protein, 13 aa, Artificial Sequence
  Description of Artificial Sequence: Synthetic linker
QLIGMLQGLMRDL

SEQ ID NO: 2280 - DNA, 39 bp, Artificial Sequence
  Description of Artificial Sequence: Synthetic linker
cagctgatagggatgctacaaggcctgatgcgtgacctg

SEQ ID NO: 2281 - DNA, 10 bp, Artificial Sequence
  Description of Artificial Sequence: Synthetic linker
  modified_base (7)..(10): a, c, t or g
agcggcnnnn

SEQ ID NO: 2282 - protein, 107 aa, Artificial Sequence
  Description of Artificial Sequence: Synthetic Destabilizing Domain (DD)
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 2283 - DNA, 321 bp, Artificial Sequence
  Description of Artificial Sequence: Synthetic Destabilizing Domain (DD)
ggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagctggag

SEQ ID NO: 2284 - protein, 159 aa, Artificial Sequence; identical to SEQ ID NO: 1173
  Description of Artificial Sequence: Synthetic Destabilizing Domain (DD)

SEQ ID NO: 2285 - DNA, 321 bp, Artificial Sequence; identical to SEQ ID NO: 2283
  Description of Artificial Sequence: Synthetic Destabilizing Domain (DD)

SEQ ID NO: 2286 - protein, 158 aa, Artificial Sequence
  Description of Artificial Sequence: Synthetic Destabilizing Domain (DD)
ISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYKPDDWESVFSEFHDADAQNSHSYCFEILERR

SEQ ID NO: 2287 - DNA, 236 bp, Artificial Sequence
  Description of Artificial Sequence: Synthetic Destabilizing Domain (DD)
atctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacga

SEQ ID NO: 2288 - protein, 187 aa, Artificial Sequence; identical to SEQ ID NO: 11
  Description of Artificial Sequence: Synthetic Destabilizing Domain (DD)

SEQ ID NO: 2289 - DNA, 561 bp, Artificial Sequence; identical to SEQ ID NO: 73
  Description of Artificial Sequence: Synthetic Destabilizing Domain (DD)

SEQ ID NO: 2290 - protein, 187 aa, Artificial Sequence; identical to SEQ ID NO: 27
  Description of Artificial Sequence: Synthetic Destabilizing Domain (DD)

SEQ ID NO: 2291 - DNA, 561 bp, Artificial Sequence; identical to SEQ ID NO: 75
  Description of Artificial Sequence: Synthetic Destabilizing Domain (DD)

SEQ ID NO: 2292 - protein, 187 aa, Artificial Sequence; identical to SEQ ID NO: 20
  Description of Artificial Sequence: Synthetic Destabilizing Domain (DD)

SEQ ID NO: 2293 - DNA, 561 bp, Artificial Sequence; identical to SEQ ID NO: 79
  Description of Artificial Sequence: Synthetic Destabilizing Domain (DD)

SEQ ID NO: 2294 - DNA, 1587 bp, Artificial Sequence
  Description of Artificial Sequence: Synthetic Payload sequence
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgagagcggcggtggcagcgacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagctga

SEQ ID NO: 2295 - DNA, 1740 bp, Artificial Sequence
  Description of Artificial Sequence: Synthetic Payload sequence
atgatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgtagcggcggtggcagcgacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagctga

SEQ ID NO: 2296 - DNA, 1824 bp, Artificial Sequence; identical to SEQ ID NO: 178
  Description of Artificial Sequence: Synthetic Payload sequence

SEQ ID NO: 2297 - DNA, 1824 bp, Artificial Sequence; identical to SEQ ID NO: 179
  Description of Artificial Sequence: Synthetic Payload sequence

SEQ ID NO: 2298 - DNA, 1824 bp, Artificial Sequence; identical to SEQ ID NO: 180
  Description of Artificial Sequence: Synthetic Payload sequence

SEQ ID NO: 2299 - DNA, 1242 bp, Artificial Sequence
  Description of Artificial Sequence: Synthetic Payload sequence
atgctggagggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagctggagagcggcggtggcagcggcgtggacgggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcggcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagccagctgatagggatgctacaaggcctgatgcgtgacctgtga

SEQ ID NO: 2300 - DNA, 1578 bp, Artificial Sequence
  Description of Artificial Sequence: Synthetic Payload sequence
atggacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagcagcggcggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggagtga

SEQ ID NO: 2301 - DNA, 1731 bp, Artificial Sequence
  Description of Artificial Sequence: Synthetic Payload sequence
atggacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagcagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 2302 - DNA, 1731 bp, Artificial Sequence
  Description of Artificial Sequence: Synthetic Payload sequence
atggacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagcagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgtttacgaacagttcctgccgaaagcgcagaaactgtacctgacccacatcgacgcggaagttgaaggtgacacccacttcccggactacaaaccggatgattgggagagcgtattctccgaattccatgatgcggatgcgcaaaactctcattcttactgttttgaaatcctggaacgtcgttga

SEQ ID NO: 2303 - DNA, 1293 bp, Artificial Sequence
  Description of Artificial Sequence: Synthetic Payload sequence
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccc

SEQ ID NO: 2304 - DNA, 1290 bp, Artificial Sequence
  Description of Artificial Sequence: Synthetic Payload sequence
ccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccc

SEQ ID NO: 2305 - DNA, 1188 bp, Artificial Sequence
  Description of Artificial Sequence: Synthetic Payload sequence
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccc

SEQ ID NO: 2306 - DNA, 1185 bp, Artificial Sequence
  Description of Artificial Sequence: Synthetic Payload sequence
ccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccc

SEQ ID NO: 2307 - DNA, 1296 bp, Artificial Sequence
  Description of Artificial Sequence: Synthetic Payload sequence
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 2308 - DNA, 1191 bp, Artificial Sequence
  Description of Artificial Sequence: Synthetic Construct
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 2309 - DNA, 1632 bp, Artificial Sequence
  Description of Artificial Sequence: Synthetic Construct
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgagtcaggtggcggtagtccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 2310 - DNA, 1785 bp, Artificial Sequence
  Description of Artificial Sequence: Synthetic Construct
atgatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttcaggtggcggtagtccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 2311 - DNA, 1623 bp, Artificial Sequence
  Description of Artificial Sequence: Synthetic Construct
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggacccagcggcggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggagtga

SEQ ID NO: 2312 - DNA, 1776 bp, Artificial Sequence
  Description of Artificial Sequence: Synthetic Construct
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggacccagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 2313 - DNA, 1518 bp, Artificial Sequence
  Description of Artificial Sequence: Synthetic Construct
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgagagcggcccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 2314 - DNA, 1671 bp, Artificial Sequence
  Description of Artificial Sequence: Synthetic Construct
atgatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgtagcggcccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 2315 - DNA, 1518 bp, Artificial Sequence
  Description of Artificial Sequence: Synthetic Construct
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggacccagcggcggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggagtga

SEQ ID NO: 2316 - DNA, 1671 bp, Artificial Sequence
  Description of Artificial Sequence: Synthetic Construct
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggacccagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 2317 - protein, 21 aa, Artificial Sequence
  Description of Artificial Sequence: Synthetic peptide
LLLVTSLLLCELPHPAFLLIP

SEQ ID NO: 2318 - protein, 22 aa, Artificial Sequence
  Description of Artificial Sequence: Synthetic peptide
LLVTSLLLCELPHPAFLLIPDT

SEQ ID NO: 2319 - protein, 24 aa, Artificial Sequence
  Description of Artificial Sequence: Synthetic peptide
MVLLVTSLLLCELPHPAFLLIPDT

SEQ ID NO: 2320 - protein, 22 aa, Homo sapiens
MCHQQLVISWFSLVFLASPLVA

SEQ ID NO: 2321 - DNA, 66 bp, Homo sapiens; identical to SEQ ID NO: 1580

SEQ ID NO: 2322 - DNA, 66 bp, Artificial Sequence; identical to SEQ ID NO: 1581
  Description of Artificial Sequence: Synthetic signal sequence

SEQ ID NO: 2323 - DNA, 66 bp, Artificial Sequence; identical to SEQ ID NO: 1582
  Description of Artificial Sequence: Synthetic signal sequence

SEQ ID NO: 2324 - DNA, 66 bp, Artificial Sequence; identical to SEQ ID NO: 1583
  Description of Artificial Sequence: Synthetic signal sequence

SEQ ID NO: 2325 - DNA, 66 bp, Artificial Sequence; identical to SEQ ID NO: 1584
  Description of Artificial Sequence: Synthetic signal sequence

SEQ ID NO: 2326 - DNA, 66 bp, Artificial Sequence; identical to SEQ ID NO: 1585
  Description of Artificial Sequence: Synthetic signal sequence

SEQ ID NO: 2327 - DNA, 66 bp, Artificial Sequence; identical to SEQ ID NO: 1586
  Description of Artificial Sequence: Synthetic signal sequence

SEQ ID NO: 2328 - DNA, 66 bp, Artificial Sequence; identical to SEQ ID NO: 1587
  Description of Artificial Sequence: Synthetic signal sequence

SEQ ID NO: 2329 - DNA, 66 bp, Artificial Sequence; identical to SEQ ID NO: 1588
  Description of Artificial Sequence: Synthetic signal sequence

SEQ ID NO: 2330 - protein, 22 aa, Homo sapiens
MCHQQLVISWFSLVFLASPLVA

SEQ ID NO: 2331 - DNA, 66 bp, Homo sapiens; identical to SEQ ID NO: 1580

SEQ ID NO: 2332 - DNA, 66 bp, Artificial Sequence; identical to SEQ ID NO: 1581
  Description of Artificial Sequence: Synthetic Signal Sequence

SEQ ID NO: 2333 - DNA, 66 bp, Artificial Sequence; identical to SEQ ID NO: 1582
  Description of Artificial Sequence: Synthetic Signal Sequence

SEQ ID NO: 2334 - DNA, 66 bp, Artificial Sequence; identical to SEQ ID NO: 1583
  Description of Artificial Sequence: Synthetic Signal Sequence

SEQ ID NO: 2335 - DNA, 66 bp, Artificial Sequence; identical to SEQ ID NO: 1584
  Description of Artificial Sequence: Synthetic Signal Sequence

SEQ ID NO: 2336 - DNA, 66 bp, Artificial Sequence; identical to SEQ ID NO: 1585
  Description of Artificial Sequence: Synthetic Signal Sequence

SEQ ID NO: 2337 - DNA, 66 bp, Artificial Sequence; identical to SEQ ID NO: 1586
  Description of Artificial Sequence: Synthetic Signal Sequence

SEQ ID NO: 2338 - DNA, 66 bp, Artificial Sequence; identical to SEQ ID NO: 1587
  Description of Artificial Sequence: Synthetic Signal Sequence

SEQ ID NO: 2339 - DNA, 66 bp, Artificial Sequence; identical to SEQ ID NO: 1588
  Description of Artificial Sequence: Synthetic Signal Sequence

SEQ ID NO: 2340 - protein, 22 aa, Artificial Sequence
  Description of Artificial Sequence: Synthetic Signal Sequence
LLVTSLLLCELPHPAFLLIPDT

SEQ ID NO: 2341 - protein, 24 aa, Artificial Sequence
  Description of Artificial Sequence: Synthetic Signal Sequence
MVLLVTSLLLCELPHPAFLLIPDT

SEQ ID NO: 2342 - protein, 30 aa, Artificial Sequence; identical to SEQ ID NO: 1919
  Description of Artificial Sequence: Synthetic signal sequence

SEQ ID NO: 2343 - DNA, 90 bp, Artificial Sequence; identical to SEQ ID NO: 1724
  Description of Artificial Sequence: Synthetic signal sequence

SEQ ID NO: 2344 - protein, 21 aa, Homo sapiens
MALPVTALLLPLALLLHAARP

SEQ ID NO: 2345 - DNA, 63 bp, Homo sapiens; identical to SEQ ID NO: 1321

SEQ ID NO: 2346 - DNA, 63 bp, Artificial Sequence; identical to SEQ ID NO: 1322
  Description of Artificial Sequence: Synthetic signal sequence

SEQ ID NO: 2347 - DNA, 63 bp, Artificial Sequence; identical to SEQ ID NO: 1323
  Description of Artificial Sequence: Synthetic signal sequence

SEQ ID NO: 2348 - DNA, 63 bp, Artificial Sequence; identical to SEQ ID NO: 1324
  Description of Artificial Sequence: Synthetic signal sequence

SEQ ID NO: 2349 - DNA, 63 bp, Artificial Sequence; identical to SEQ ID NO: 1325
  Description of Artificial Sequence: Synthetic signal sequence

SEQ ID NO: 2350 - protein, 18 aa, Homo sapiens
MDWTWILFLVAAATRVHS

SEQ ID NO: 2351 - DNA, 54 bp, Homo sapiens; identical to SEQ ID NO: 1850

SEQ ID NO: 2352 - protein, 30 aa, Homo sapiens; identical to SEQ ID NO: 1919

SEQ ID NO: 2353 - DNA, 90 bp, Homo sapiens; identical to SEQ ID NO: 1724

SEQ ID NO: 2354 - protein, 9 aa, Homo sapiens
SARNRQKRS

SEQ ID NO: 2355 - DNA, 27 bp, Homo sapiens
agcgccaggaatcgccagaagcggtcc

SEQ ID NO: 2356 - protein, 8 aa, Homo sapiens
ARNRQKRS

SEQ ID NO: 2357 - DNA, 24 bp, Homo sapiens
gcccggaatagacagaagagatct

SEQ ID NO: 2358 - protein, 14 aa, Artificial Sequence
  Description of Artificial Sequence: Synthetic cleavage site
SGESRRVRRNKRSK

SEQ ID NO: 2359 - DNA, 42 bp, Artificial Sequence
  Description of Artificial Sequence: Synthetic cleavage site
agtggtgagtccaggagagtgcggcgcaacaagaggagcaag

SEQ ID NO: 2360 - protein, 19 aa, Artificial Sequence
  Description of Artificial Sequence: Synthetic cleavage site
ATNFSLLKQAGDVEENPGP

SEQ ID NO: 2361 - DNA, 57 bp, Artificial Sequence
  Description of Artificial Sequence: Synthetic cleavage site
gctactaacttcagcctgctgaagcaggctggagacgtggaggagaaccctggacct

SEQ ID NO: 2362 - protein, 4 aa, Artificial Sequence
  Description of Artificial Sequence: Synthetic peptide
NPGP

SEQ ID NO: 2363 - protein, 9 aa, Homo sapiens
SARNRQKRS

SEQ ID NO: 2364 - DNA, 27 bp, Homo sapiens
agcgccaggaatcgccagaagcggtcc

SEQ ID NO: 2365 - protein, 8 aa, Homo sapiens
ARNRQKRS

SEQ ID NO: 2366 - DNA, 24 bp, Homo sapiens
gcccggaatagacagaagagatct

SEQ ID NO: 2367 - protein, 12 aa, Homo sapiens
ESRRVRRNKRSK

SEQ ID NO: 2368 - DNA, 36 bp, Artificial Sequence; identical to SEQ ID NO: 1337
  Description of Artificial Sequence: Synthetic Cleavage site

SEQ ID NO: 2369 - DNA, 36 bp, Artificial Sequence; identical to SEQ ID NO: 1338
  Description of Artificial Sequence: Synthetic Cleavage site

SEQ ID NO: 2370 - DNA, 24 bp, Artificial Sequence
  Description of Artificial Sequence: Synthetic oligonucleotide
gcccggaatagacagaagagatct

SEQ ID NO: 2371 - DNA, 36 bp, Artificial Sequence; identical to SEQ ID NO: 1339
  Description of Artificial Sequence: Synthetic Cleavage site

SEQ ID NO: 2372 - protein, 14 aa, Artificial Sequence
  Description of Artificial Sequence: Synthetic Cleavage site
SGESRRVRRNKRSK

SEQ ID NO: 2373 - DNA, 57 bp, Artificial Sequence; identical to SEQ ID NO: 2361
  Description of Artificial Sequence: Synthetic Cleavage site

SEQ ID NO: 2374 - protein, 19 aa, Artificial Sequence
  Description of Artificial Sequence: Synthetic Cleavage site
ATNFSLLKQAGDVEENPGP

SEQ ID NO: 2375 - protein, 20 aa, Artificial Sequence
  Description of Artificial Sequence: Synthetic Cleavage site
GATNFSLLKQAGDVEENPGP

SEQ ID NO: 2376 - DNA, 60 bp, Artificial Sequence; identical to SEQ ID NO: 1806
  Description of Artificial Sequence: Synthetic Cleavage site

SEQ ID NO: 2377 - protein, 4 aa, Artificial Sequence
  Description of Artificial Sequence: Synthetic Cleavage site
NPGP

SEQ ID NO: 2378 - protein, 9 aa, Homo sapiens
SARNRQKRS

SEQ ID NO: 2379 - DNA, 27 bp, Homo sapiens
agcgccaggaatcgccagaagcggtcc

SEQ ID NO: 2380 - protein, 8 aa, Homo sapiens
ARNRQKRS

SEQ ID NO: 2381 - DNA, 24 bp, Homo sapiens
gcccggaatagacagaagagatct

SEQ ID NO: 2382 - protein, 12 aa, Homo sapiens
ESRRVRRNKRSK

SEQ ID NO: 2383 - DNA, 36 bp, Artificial Sequence; identical to SEQ ID NO: 1337
  Description of Artificial Sequence: Synthetic cleavage site

SEQ ID NO: 2384 - DNA, 36 bp, Artificial Sequence; identical to SEQ ID NO: 1338
  Description of Artificial Sequence: Synthetic cleavage site

SEQ ID NO: 2385 - DNA, 36 bp, Artificial Sequence; identical to SEQ ID NO: 1339
  Description of Artificial Sequence: Synthetic cleavage site

SEQ ID NO: 2386 - protein, 9 aa, Artificial Sequence
  Description of Artificial Sequence: Synthetic HA Tag
YPYDVPDYA

SEQ ID NO: 2387 - DNA, 27 bp, Artificial Sequence
  Description of Artificial Sequence: Synthetic HA Tag
tacccatacgatgttccagattacgct

SEQ ID NO: 2388 - DNA, 27 bp, Artificial Sequence
  Description of Artificial Sequence: Synthetic HA Tag
tatccttacgatgtgcccgactatgct

SEQ ID NO: 2389 - DNA, 27 bp, Artificial Sequence
  Description of Artificial Sequence: Synthetic HA Tag
tatccgtacgacgtaccagactacgca

SEQ ID NO: 2390 - protein, 4 aa, Artificial Sequence
  Description of Artificial Sequence: Synthetic linker
GGSG

SEQ ID NO: 2391 - DNA, 12 bp, Artificial Sequence
  Description of Artificial Sequence: Synthetic linker
ggaggatctgga

SEQ ID NO: 2392 - DNA, 27 bp, Artificial Sequence
  Description of Artificial Sequence: Synthetic linker
ggaggtagtggtggaggcagtggtgga

SEQ ID NO: 2393 - protein, 5 aa, Artificial Sequence
  Description of Artificial Sequence: Synthetic linker
GGGGG

SEQ ID NO: 2394 - protein, 5 aa, Artificial Sequence
  Description of Artificial Sequence: Synthetic linker
GGGGS

SEQ ID NO: 2395 - protein, 10 aa, Artificial Sequence
  Description of Artificial Sequence: Synthetic linker
GGGGSGGGGS

SEQ ID NO: 2396 - protein, 15 aa, Artificial Sequence
  Description of Artificial Sequence: Synthetic linker
GGGGSGGGGSGGGGS

SEQ ID NO: 2397 - protein, 20 aa, Artificial Sequence
  Description of Artificial Sequence: Synthetic linker
GGGGSGGGGSGGGGSGGGGS

SEQ ID NO: 2398 - protein, 25 aa, Artificial Sequence
  Description of Artificial Sequence: Synthetic linker
GGGGSGGGGSGGGGSGGGGSGGGGS

SEQ ID NO: 2399 - protein, 30 aa, Artificial Sequence
  Description of Artificial Sequence: Synthetic linker
GGGGSGGGGSGGGGSGGGGSGGGGSGGGGS

SEQ ID NO: 2400 - protein, 5 aa, Artificial Sequence
  Description of Artificial Sequence: Synthetic linker
SSSSG

SEQ ID NO: 2401 - protein, 10 aa, Artificial Sequence
  Description of Artificial Sequence: Synthetic linker
SSSSGSSSSG

SEQ ID NO: 2402 - protein, 15 aa, Artificial Sequence
  Description of Artificial Sequence: Synthetic linker
SSSSGSSSSGSSSSG

SEQ ID NO: 2403 - protein, 20 aa, Artificial Sequence
  Description of Artificial Sequence: Synthetic linker
SSSSGSSSSGSSSSGSSSSG

SEQ ID NO: 2404 - protein, 25 aa, Artificial Sequence
  Description of Artificial Sequence: Synthetic linker
SSSSGSSSSGSSSSGSSSSGSSSSG

SEQ ID NO: 2405 - protein, 30 aa, Artificial Sequence
  Description of Artificial Sequence: Synthetic linker
SSSSGSSSSGSSSSGSSSSGSSSSGSSSSG

SEQ ID NO: 2406 - protein, 6 aa, Artificial Sequence
  Description of Artificial Sequence: Synthetic linker
EFSTEF

SEQ ID NO: 2407 - DNA, 18 bp, Artificial Sequence
  Description of Artificial Sequence: Synthetic linker
gagttcagcaccgagttt

SEQ ID NO: 2408 - DNA, 18 bp, Artificial Sequence
  Description of Artificial Sequence: Synthetic linker
gagttctccaccgagttc

SEQ ID NO: 2409 - protein, 5 aa, Artificial Sequence
  Description of Artificial Sequence: Synthetic linker
SGGGS

SEQ ID NO: 2410 - DNA, 15 bp, Artificial Sequence
  Description of Artificial Sequence: Synthetic linker
agcggcggtggcagc

SEQ ID NO: 2411 - protein, 12 aa, Artificial Sequence
  Description of Artificial Sequence: Synthetic linker
GKSSGSGSESKS

SEQ ID NO: 2412 - protein, 15 aa, Artificial Sequence
  Description of Artificial Sequence: Synthetic linker
GGSTSGSGKSSEGKG

SEQ ID NO: 2413 - protein, 19 aa, Artificial Sequence
  Description of Artificial Sequence: Synthetic linker
GSTSGSGKSSSEGSGSTKG

SEQ ID NO: 2414 - protein, 18 aa, Artificial Sequence
  Description of Artificial Sequence: Synthetic linker
GSTSGSGKPGSGEGSTKG

SEQ ID NO: 2415 - protein, 13 aa, Artificial Sequence
  Description of Artificial Sequence: Synthetic linker
VDYPYDVPDYALD

SEQ ID NO: 2416 - DNA, 39 bp, Artificial Sequence; identical to SEQ ID NO: 2274
  Description of Artificial Sequence: Synthetic linker

SEQ ID NO: 2417 - protein, 14 aa, Artificial Sequence
  Description of Artificial Sequence: Synthetic linker
EGKSSGSGSESKEF

SEQ ID NO: 2418 - protein, 35 aa, Artificial Sequence
  Description of Artificial Sequence: Synthetic linker
SGGGSGGGGSGGGGSGGGGSGGGSLQYPYDVPDYA

SEQ ID NO: 2419 - DNA, 105 bp, Artificial Sequence
  Description of Artificial Sequence: Synthetic linker
tcaggtggcggtagtggtgggggaggatctggaggcggaggaagcgggggtggaggttcaggtggaggcagcttgcaatacccatacgatgttccagattacgct

SEQ ID NO: 2420 - protein, 8 aa, Artificial Sequence
  Description of Artificial Sequence: Synthetic linker
DYKDDDDK

SEQ ID NO: 2421 - DNA, 24 bp, Artificial Sequence
  Description of Artificial Sequence: Synthetic linker
gactacaaagacgatgacgacaag

SEQ ID NO: 2422 - protein, 34 aa, Artificial Sequence; identical to SEQ ID NO: 1924
  Description of Artificial Sequence: Synthetic linker

SEQ ID NO: 2423 - DNA, 102 bp, Artificial Sequence; identical to SEQ ID NO: 1925
  Description of Artificial Sequence: Synthetic linker

SEQ ID NO: 2424 - protein, 34 aa, Artificial Sequence
  Description of Artificial Sequence: Synthetic linker
SGGGSGGGGSGGGGSGGGGSYPYDVPDYASGGGS

SEQ ID NO: 2425 - DNA, 102 bp, Artificial Sequence
  Description of Artificial Sequence: Synthetic linker
agtggtggcgggtccggcggtggtggtagcgggggtggaggctcaggtggcggtggcagttatccttacgatgtgcccgactatgcttcaggcggggggagt

SEQ ID NO: 2426 - protein, 22 aa, Artificial Sequence
  Description of Artificial Sequence: Synthetic linker
GSGATNFSLLKQAGDVEENPGP

SEQ ID NO: 2427 - DNA, 66 bp, Artificial Sequence
  Description of Artificial Sequence: Synthetic linker
ggttcaggagctactaacttcagcctgctgaagcaggctggagacgtggaggagaaccctggacct

SEQ ID NO: 2428 - protein, 22 aa, Artificial Sequence
  Description of Artificial Sequence: Synthetic linker
SGGGGSGGGGSGGGGSGGGSLQ

SEQ ID NO: 2429 - protein, 14 aa, Artificial Sequence
  Description of Artificial Sequence: Synthetic linker
EGKSSGSGSESKEF

SEQ ID NO: 2430 - protein, 35 aa, Artificial Sequence; identical to SEQ ID NO: 2418
  Description of Artificial Sequence: Synthetic linker

SEQ ID NO: 2431 - DNA, 105 bp, Artificial Sequence; identical to SEQ ID NO: 2419
  Description of Artificial Sequence: Synthetic linker

SEQ ID NO: 2432 - protein, 8 aa, Artificial Sequence
  Description of Artificial Sequence: Synthetic linker
DYKDDDDK

SEQ ID NO: 2433 - DNA, 24 bp, Artificial Sequence
  Description of Artificial Sequence: Synthetic linker
gactacaaagacgatgacgacaag

SEQ ID NO: 2434 - protein, 34 aa, Artificial Sequence; identical to SEQ ID NO: 1924
  Description of Artificial Sequence: Synthetic linker

SEQ ID NO: 2435 - DNA, 102 bp, Artificial Sequence; identical to SEQ ID NO: 1925
  Description of Artificial Sequence: Synthetic linker

SEQ ID NO: 2436 - protein, 34 aa, Artificial Sequence; identical to SEQ ID NO: 2424
  Description of Artificial Sequence: Synthetic linker

SEQ ID NO: 2437 - DNA, 102 bp, Artificial Sequence; identical to SEQ ID NO: 2425
  Description of Artificial Sequence: Synthetic linker

SEQ ID NO: 2438 - protein, 22 aa, Artificial Sequence
  Description of Artificial Sequence: Synthetic linker
GSGATNFSLLKQAGDVEENPGP

SEQ ID NO: 2439 - DNA, 66 bp, Artificial Sequence; identical to SEQ ID NO: 2427
  Description of Artificial Sequence: Synthetic linker

SEQ ID NO: 2440 - protein, 4 aa, Artificial Sequence
  Description of Artificial Sequence: Synthetic linker
GGSG

SEQ ID NO: 2441 - DNA, 12 bp, Artificial Sequence
  Description of Artificial Sequence: Synthetic linker
ggaggatctgga

SEQ ID NO: 2442 - protein, 5 aa, Artificial Sequence
  Description of Artificial Sequence: Synthetic linker
GGSGG

SEQ ID NO: 2443 - DNA, 15 bp, Artificial Sequence
  Description of Artificial Sequence: Synthetic linker
ggaggcagcggagga

SEQ ID NO: 2444 - DNA, 15 bp, Artificial Sequence
  Description of Artificial Sequence: Synthetic linker
ggaggctctggagga

SEQ ID NO: 2445 - DNA, 15 bp, Artificial Sequence
  Description of Artificial Sequence: Synthetic linker
ggaggctccggcgga

SEQ ID NO: 2446 - DNA, 15 bp, Artificial Sequence
  Description of Artificial Sequence: Synthetic linker
ggaggatccggaggc

SEQ ID NO: 2447 - DNA, 15 bp, Artificial Sequence
  Description of Artificial Sequence: Synthetic linker
ggaggatctggagga

SEQ ID NO: 2448 - protein, 6 aa, Artificial Sequence
  Description of Artificial Sequence: Synthetic linker
GGSGGG

SEQ ID NO: 2449 - DNA, 18 bp, Artificial Sequence
  Description of Artificial Sequence: Synthetic linker
ggtggctctggtggtggt

SEQ ID NO: 2450 - DNA, 18 bp, Artificial Sequence
  Description of Artificial Sequence: Synthetic linker
ggaggtagtggtggaggc

SEQ ID NO: 2451 - protein, 9 aa, Artificial Sequence
  Description of Artificial Sequence: Synthetic linker
GGSGGGSGG

SEQ ID NO: 2452 - DNA, 27 bp, Artificial Sequence
  Description of Artificial Sequence: Synthetic linker
ggaggtagtggtggaggcagtggtgga

SEQ ID NO: 2453 - protein, 5 aa, Artificial Sequence
  Description of Artificial Sequence: Synthetic linker
GGGGG

SEQ ID NO: 2454 - protein, 5 aa, Artificial Sequence
  Description of Artificial Sequence: Synthetic linker
GGGGS

SEQ ID NO: 2455 - protein, 10 aa, Artificial Sequence
  Description of Artificial Sequence: Synthetic linker
GGGGSGGGGS

SEQ ID NO: 2456 - protein, 15 aa, Artificial Sequence
  Description of Artificial Sequence: Synthetic linker
GGGGSGGGGSGGGGS

SEQ ID NO: 2457 - DNA, 45 bp, Artificial Sequence; identical to SEQ ID NO: 1636
  Description of Artificial Sequence: Synthetic linker

SEQ ID NO: 2458 - DNA, 45 bp, Artificial Sequence; identical to SEQ ID NO: 1637
  Description of Artificial Sequence: Synthetic linker

SEQ ID NO: 2459 - protein, 26 aa, Artificial Sequence
  Description of Artificial Sequence: Synthetic linker
SGGGSGGGGSGGGGSGGGGSGGGSLQ

SEQ ID NO: 2460 - DNA, 45 bp, Artificial Sequence; identical to SEQ ID NO: 1639
  Description of Artificial Sequence: Synthetic linker

SEQ ID NO: 2461 - DNA, 45 bp, Artificial Sequence; identical to SEQ ID NO: 1640
  Description of Artificial Sequence: Synthetic linker

SEQ ID NO: 2462 - DNA, 45 bp, Artificial Sequence; identical to SEQ ID NO: 1641
  Description of Artificial Sequence: Synthetic linker

SEQ ID NO: 2463 - protein, 20 aa, Artificial Sequence
  Description of Artificial Sequence: Synthetic linker
GGGGSGGGGSGGGGSGGGGS

SEQ ID NO: 2464 - protein, 25 aa, Artificial Sequence
  Description of Artificial Sequence: Synthetic linker
GGGGSGGGGSGGGGSGGGGSGGGGS

SEQ ID NO: 2465 - protein, 30 aa, Artificial Sequence; identical to SEQ ID NO: 2399
  Description of Artificial Sequence: Synthetic linker

SEQ ID NO: 2466 - protein, 5 aa, Artificial Sequence
  Description of Artificial Sequence: Synthetic linker
SSSSG

SEQ ID NO: 2467 - protein, 10 aa, Artificial Sequence
  Description of Artificial Sequence: Synthetic linker
SSSSGSSSSG

SEQ ID NO: 2468 - protein, 15 aa, Artificial Sequence
  Description of Artificial Sequence: Synthetic linker
SSSSGSSSSGSSSSG

SEQ ID NO: 2469 - protein, 20 aa, Artificial Sequence
  Description of Artificial Sequence: Synthetic linker
SSSSGSSSSGSSSSGSSSSG

SEQ ID NO: 2470 - protein, 25 aa, Artificial Sequence
  Description of Artificial Sequence: Synthetic linker
SSSSGSSSSGSSSSGSSSSGSSSSG

SEQ ID NO: 2471 - protein, 30 aa, Artificial Sequence; identical to SEQ ID NO: 2405
  Description of Artificial Sequence: Synthetic linker

SEQ ID NO: 2472 - DNA, 78 bp, Artificial Sequence; identical to SEQ ID NO: 1647
  Description of Artificial Sequence: Synthetic linker

SEQ ID NO: 2473 - DNA, 78 bp, Artificial Sequence; identical to SEQ ID NO: 1648
  Description of Artificial Sequence: Synthetic linker

SEQ ID NO: 2474 - DNA, 78 bp, Artificial Sequence; identical to SEQ ID NO: 1649
  Description of Artificial Sequence: Synthetic linker

SEQ ID NO: 2475 - DNA, 78 bp, Artificial Sequence; identical to SEQ ID NO: 1650
  Description of Artificial Sequence: Synthetic linker

SEQ ID NO: 2476 - DNA, 78 bp, Artificial Sequence; identical to SEQ ID NO: 1651
  Description of Artificial Sequence: Synthetic linker

SEQ ID NO: 2477 - DNA, 78 bp, Artificial Sequence; identical to SEQ ID NO: 1652
  Description of Artificial Sequence: Synthetic linker

SEQ ID NO: 2478 - DNA, 78 bp, Artificial Sequence; identical to SEQ ID NO: 1650
  Description of Artificial Sequence: Synthetic linker

SEQ ID NO: 2479 - DNA, 18 bp, Artificial Sequence
  Description of Artificial Sequence: Synthetic linker
gagttctccaccgagttc

SEQ ID NO: 2480 - protein, 12 aa, Artificial Sequence
  Description of Artificial Sequence: Synthetic linker
GKSSGSGSESKS

SEQ ID NO: 2481 - protein, 15 aa, Artificial Sequence
  Description of Artificial Sequence: Synthetic linker
GGSTSGSGKSSEGKG

SEQ ID NO: 2482 - protein, 19 aa, Artificial Sequence
  Description of Artificial Sequence: Synthetic linker
GSTSGSGKSSSEGSGSTKG

SEQ ID NO: 2483 - protein, 18 aa, Artificial Sequence
  Description of Artificial Sequence: Synthetic linker
GSTSGSGKPGSGEGSTKG

SEQ ID NO: 2484 - protein, 20 aa, Artificial Sequence
  Description of Artificial Sequence: Synthetic linker
SGGGSGGGGSGGGGSGGGGS

SEQ ID NO: 2485 - protein, 4 aa, Artificial Sequence
  Description of Artificial Sequence: Synthetic linker
GGGG

SEQ ID NO: 2486 - protein, 8 aa, Artificial Sequence
  Description of Artificial Sequence: Synthetic linker
GGGGGGGG

SEQ ID NO: 2487 - protein, 8 aa, Artificial Sequence
  Description of Artificial Sequence: Synthetic linker
  MOD_RES (4)..(4): Any naturally occurring amino acid
DVEXNPGP

SEQ ID NO: 2488 - protein, 8 aa, Artificial Sequence
  Description of Artificial Sequence: Synthetic linker
  MOD_RES (4)..(4): Any naturally occurring amino acid
DIEXNPGP

SEQ ID NO: 2489 - DNA, 561 bp, Artificial Sequence; identical to SEQ ID NO: 73
  Description of Artificial Sequence: Synthetic destabilizing domain (DD)

SEQ ID NO: 2490 - DNA, 561 bp, Artificial Sequence; identical to SEQ ID NO: 76
  Description of Artificial Sequence: Synthetic destabilizing domain (DD)

SEQ ID NO: 2491 - DNA, 561 bp, Artificial Sequence; identical to SEQ ID NO: 82
  Description of Artificial Sequence: Synthetic destabilizing domain (DD)

SEQ ID NO: 2492 - DNA, 561 bp, Artificial Sequence; identical to SEQ ID NO: 74
  Description of Artificial Sequence: Synthetic destabilizing domain (DD)

SEQ ID NO: 2493 - DNA, 561 bp, Artificial Sequence; identical to SEQ ID NO: 84
  Description of Artificial Sequence: Synthetic destabilizing domain (DD)

SEQ ID NO: 2494 - DNA, 561 bp, Artificial Sequence; identical to SEQ ID NO: 78
  Description of Artificial Sequence: Synthetic destabilizing domain (DD)

SEQ ID NO: 2495 - DNA, 561 bp, Artificial Sequence; identical to SEQ ID NO: 75
  Description of Artificial Sequence: Synthetic destabilizing domain (DD)

SEQ ID NO: 2496 - DNA, 561 bp, Artificial Sequence; identical to SEQ ID NO: 79
  Description of Artificial Sequence: Synthetic destabilizing domain (DD)

SEQ ID NO: 2497 - DNA, 561 bp, Artificial Sequence; identical to SEQ ID NO: 81
  Description of Artificial Sequence: Synthetic destabilizing domain (DD)

SEQ ID NO: 2498 - DNA, 561 bp, Artificial Sequence; identical to SEQ ID NO: 93
  Description of Artificial Sequence: Synthetic destabilizing domain (DD)

SEQ ID NO: 2499 - DNA, 561 bp, Artificial Sequence; identical to SEQ ID NO: 92
  Description of Artificial Sequence: Synthetic destabilizing domain (DD)

SEQ ID NO: 2500 - DNA, 561 bp, Artificial Sequence; identical to SEQ ID NO: 94
  Description of Artificial Sequence: Synthetic destabilizing domain (DD)

SEQ ID NO: 2501 - DNA, 561 bp, Artificial Sequence; identical to SEQ ID NO: 90
  Description of Artificial Sequence: Synthetic destabilizing domain (DD)

SEQ ID NO: 2502 - DNA, 561 bp, Artificial Sequence; identical to SEQ ID NO: 96
  Description of Artificial Sequence: Synthetic destabilizing domain (DD)

SEQ ID NO: 2503 - DNA, 561 bp, Artificial Sequence; identical to SEQ ID NO: 98
  Description of Artificial Sequence: Synthetic destabilizing domain (DD)

SEQ ID NO: 2504 - DNA, 561 bp, Artificial Sequence; identical to SEQ ID NO: 110
  Description of Artificial Sequence: Synthetic destabilizing domain (DD)

SEQ ID NO: 2505 - DNA, 561 bp, Artificial Sequence; identical to SEQ ID NO: 99
  Description of Artificial Sequence: Synthetic destabilizing domain (DD)

SEQ ID NO: 2506 - DNA, 561 bp, Artificial Sequence; identical to SEQ ID NO: 103
  Description of Artificial Sequence: Synthetic destabilizing domain (DD)

SEQ ID NO: 2507 - DNA, 561 bp, Artificial Sequence; identical to SEQ ID NO: 97
  Description of Artificial Sequence: Synthetic destabilizing domain (DD)

SEQ ID NO: 2508 - DNA, 561 bp, Artificial Sequence; identical to SEQ ID NO: 95
  Description of Artificial Sequence: Synthetic destabilizing domain (DD)

SEQ ID NO: 2509 - DNA, 561 bp, Artificial Sequence; identical to SEQ ID NO: 112
  Description of Artificial Sequence: Synthetic destabilizing domain (DD)

SEQ ID NO: 2510 - DNA, 561 bp, Artificial Sequence; identical to SEQ ID NO: 111
  Description of Artificial Sequence: Synthetic destabilizing domain (DD)

SEQ ID NO: 2511 - DNA, 561 bp, Artificial Sequence; identical to SEQ ID NO: 100
  Description of Artificial Sequence: Synthetic destabilizing domain (DD)

SEQ ID NO: 2512 - DNA, 561 bp, Artificial Sequence; identical to SEQ ID NO: 108
  Description of Artificial Sequence: Synthetic destabilizing domain (DD)

SEQ ID NO: 2513 - DNA, 561 bp, Artificial Sequence; identical to SEQ ID NO: 113
  Description of Artificial Sequence: Synthetic destabilizing domain (DD)

SEQ ID NO: 2514 - DNA, 561 bp, Artificial Sequence; identical to SEQ ID NO: 91
  Description of Artificial Sequence: Synthetic destabilizing domain (DD)

SEQ ID NO: 2515 - DNA, 561 bp, Artificial Sequence; identical to SEQ ID NO: 101
  Description of Artificial Sequence: Synthetic destabilizing domain (DD)

SEQ ID NO: 2516 - DNA, 561 bp, Artificial Sequence; identical to SEQ ID NO: 105
  Description of Artificial Sequence: Synthetic destabilizing domain (DD)

SEQ ID NO: 2517 - DNA, 561 bp, Artificial Sequence; identical to SEQ ID NO: 102
  Description of Artificial Sequence: Synthetic destabilizing domain (DD)

SEQ ID NO: 2518 - DNA, 561 bp, Artificial Sequence; identical to SEQ ID NO: 104
  Description of Artificial Sequence: Synthetic destabilizing domain (DD)

SEQ ID NO: 2519 - DNA, 561 bp, Artificial Sequence; identical to SEQ ID NO: 106
  Description of Artificial Sequence: Synthetic destabilizing domain (DD)

SEQ ID NO: 2520 - DNA, 561 bp, Artificial Sequence; identical to SEQ ID NO: 109
  Description of Artificial Sequence: Synthetic destabilizing domain (DD)

SEQ ID NO: 2521 - DNA, 561 bp, Artificial Sequence; identical to SEQ ID NO: 114
  Description of Artificial Sequence: Synthetic destabilizing domain (DD)

SEQ ID NO: 2522 - DNA, 561 bp, Artificial Sequence; identical to SEQ ID NO: 115
  Description of Artificial Sequence: Synthetic destabilizing domain (DD)

SEQ ID NO: 2523 - DNA, 561 bp, Artificial Sequence; identical to SEQ ID NO: 116
  Description of Artificial Sequence: Synthetic destabilizing domain (DD)

SEQ ID NO: 2524 - DNA, 561 bp, Artificial Sequence; identical to SEQ ID NO: 117
  Description of Artificial Sequence: Synthetic destabilizing domain (DD)

SEQ ID NO: 2525 - DNA, 561 bp, Artificial Sequence; identical to SEQ ID NO: 118
  Description of Artificial Sequence: Synthetic destabilizing domain (DD)

SEQ ID NO: 2526 - DNA, 561 bp, Artificial Sequence; identical to SEQ ID NO: 119
  Description of Artificial Sequence: Synthetic destabilizing domain (DD)

SEQ ID NO: 2527 - DNA, 561 bp, Artificial Sequence; identical to SEQ ID NO: 80
  Description of Artificial Sequence: Synthetic destabilizing domain (DD)

SEQ ID NO: 2528 - DNA, 561 bp, Artificial Sequence; identical to SEQ ID NO: 120
  Description of Artificial Sequence: Synthetic destabilizing domain (DD)

SEQ ID NO: 2529 - DNA, 561 bp, Artificial Sequence; identical to SEQ ID NO: 121
  Description of Artificial Sequence: Synthetic destabilizing domain (DD)

SEQ ID NO: 2530 - DNA, 561 bp, Artificial Sequence; identical to SEQ ID NO: 122
  Description of Artificial Sequence: Synthetic destabilizing domain (DD)

SEQ ID NO: 2531 - DNA, 561 bp, Artificial Sequence; identical to SEQ ID NO: 123
  Description of Artificial Sequence: Synthetic destabilizing domain (DD)

SEQ ID NO: 2532 - DNA, 561 bp, Artificial Sequence; identical to SEQ ID NO: 124
  Description of Artificial Sequence: Synthetic destabilizing domain (DD)

SEQ ID NO: 2533 - DNA, 558 bp, Artificial Sequence; identical to SEQ ID NO: 125
  Description of Artificial Sequence: Synthetic destabilizing domain (DD)

SEQ ID NO: 2534 - DNA, 561 bp, Artificial Sequence; identical to SEQ ID NO: 107
  Description of Artificial Sequence: Synthetic destabilizing domain (DD)

SEQ ID NO: 2535 - DNA, 561 bp, Artificial Sequence; identical to SEQ ID NO: 114
  Description of Artificial Sequence: Synthetic destabilizing domain (DD)

SEQ ID NO: 2536 - DNA, 561 bp, Artificial Sequence; identical to SEQ ID NO: 115
  Description of Artificial Sequence: Synthetic destabilizing domain (DD)

SEQ ID NO: 2537 - DNA, 561 bp, Artificial Sequence; identical to SEQ ID NO: 116
  Description of Artificial Sequence: Synthetic destabilizing domain (DD)

SEQ ID NO: 2538 - DNA, 561 bp, Artificial Sequence; identical to SEQ ID NO: 117
  Description of Artificial Sequence: Synthetic destabilizing domain (DD)

SEQ ID NO: 2539 - DNA, 561 bp, Artificial Sequence; identical to SEQ ID NO: 118
  Description of Artificial Sequence: Synthetic destabilizing domain (DD)

SEQ ID NO: 2540 - DNA, 321 bp, Artificial Sequence; identical to SEQ ID NO: 1664
  Description of Artificial Sequence: Synthetic Destabilizing Domain (DD)

SEQ ID NO: 2541 - DNA, 321 bp, Artificial Sequence; identical to SEQ ID NO: 1666
  Description of Artificial Sequence: Synthetic Destabilizing Domain (DD)

SEQ ID NO: 2542 - DNA, 321 bp, Artificial Sequence; identical to SEQ ID NO: 1667
  Description of Artificial Sequence: Synthetic Destabilizing Domain (DD)

SEQ ID NO: 2543 - DNA, 561 bp, Artificial Sequence; identical to SEQ ID NO: 73
  Description of Artificial Sequence: Synthetic Destabilizing Domain (DD)

SEQ ID NO: 2544 - DNA, 561 bp, Artificial Sequence; identical to SEQ ID NO: 82
  Description of Artificial Sequence: Synthetic Destabilizing Domain (DD)

SEQ ID NO: 2545 - DNA, 561 bp, Artificial Sequence; identical to SEQ ID NO: 74
  Description of Artificial Sequence: Synthetic Destabilizing Domain (DD)

SEQ ID NO: 2546 - DNA, 561 bp, Artificial Sequence; identical to SEQ ID NO: 80
  Description of Artificial Sequence: Synthetic Destabilizing Domain (DD)

SEQ ID NO: 2547 - DNA, 561 bp, Artificial Sequence; identical to SEQ ID NO: 78
  Description of Artificial Sequence: Synthetic Destabilizing Domain (DD)

SEQ ID NO: 2548 - DNA, 561 bp, Artificial Sequence; identical to SEQ ID NO: 75
  Description of Artificial Sequence: Synthetic Destabilizing Domain (DD)

SEQ ID NO: 2549 - DNA, 561 bp, Artificial Sequence; identical to SEQ ID NO: 79
  Description of Artificial Sequence: Synthetic Destabilizing Domain (DD)

SEQ ID NO: 2550 - DNA, 561 bp, Artificial Sequence; identical to SEQ ID NO: 81
  Description of Artificial Sequence: Synthetic Destabilizing Domain (DD)

SEQ ID NO: 2551 - DNA, 561 bp, Artificial Sequence; identical to SEQ ID NO: 76
  Description of Artificial Sequence: Synthetic Destabilizing Domain (DD)

SEQ ID NO: 2552 - DNA, 561 bp, Artificial Sequence; identical to SEQ ID NO: 84
  Description of Artificial Sequence: Synthetic Destabilizing Domain (DD)

SEQ ID NO: 2553 - DNA, 558 bp, Artificial Sequence; identical to SEQ ID NO: 86
  Description of Artificial Sequence: Synthetic Destabilizing Domain (DD)

SEQ ID NO: 2554 - DNA, 561 bp, Artificial Sequence; identical to SEQ ID NO: 107
  Description of Artificial Sequence: Synthetic Destabilizing Domain (DD)

SEQ ID NO: 2555 - DNA, 321 bp, Artificial Sequence; identical to SEQ ID NO: 1664
  Description of Artificial Sequence: Synthetic Destabilized Domain (DD)

SEQ ID NO: 2556 - DNA, 321 bp, Artificial Sequence; identical to SEQ ID NO: 1665
  Description of Artificial Sequence: Synthetic Destabilized Domain (DD)

SEQ ID NO: 2557 - DNA, 321 bp, Artificial Sequence; identical to SEQ ID NO: 1666
  Description of Artificial Sequence: Synthetic Destabilized Domain (DD)

SEQ ID NO: 2558 - DNA, 324 bp, Artificial Sequence; identical to SEQ ID NO: 1669
  Description of Artificial Sequence: Synthetic Destabilized Domain (DD)

SEQ ID NO: 2559 - DNA, 324 bp, Artificial Sequence; identical to SEQ ID NO: 1670
  Description of Artificial Sequence: Synthetic Destabilized Domain (DD)

SEQ ID NO: 2560 - DNA, 324 bp, Artificial Sequence; identical to SEQ ID NO: 1671
  Description of Artificial Sequence: Synthetic Destabilized Domain (DD)

SEQ ID NO: 2561 - DNA, 558 bp, Artificial Sequence; identical to SEQ ID NO: 86
  Description of Artificial Sequence: Synthetic Destabilized Domain (DD)

SEQ ID NO: 2562 - DNA, 561 bp, Artificial Sequence; identical to SEQ ID NO: 73
  Description of Artificial Sequence: Synthetic Destabilizing Domain (DD)

SEQ ID NO: 2563 - DNA, 561 bp, Artificial Sequence; identical to SEQ ID NO: 82
  Description of Artificial Sequence: Synthetic Destabilizing Domain (DD)

SEQ ID NO: 2564 - DNA, 561 bp, Artificial Sequence; identical to SEQ ID NO: 74
  Description of Artificial Sequence: Synthetic Destabilizing Domain (DD)

SEQ ID NO: 2565 - DNA, 561 bp, Artificial Sequence; identical to SEQ ID NO: 80
  Description of Artificial Sequence: Synthetic Destabilizing Domain (DD)

SEQ ID NO: 2566 - DNA, 561 bp, Artificial Sequence; identical to SEQ ID NO: 78
  Description of Artificial Sequence: Synthetic Destabilizing Domain (DD)

SEQ ID NO: 2567 - DNA, 561 bp, Artificial Sequence; identical to SEQ ID NO: 75
  Description of Artificial Sequence: Synthetic Destabilizing Domain (DD)

SEQ ID NO: 2568 - DNA, 561 bp, Artificial Sequence; identical to SEQ ID NO: 79
  Description of Artificial Sequence: Synthetic Destabilizing Domain (DD)

SEQ ID NO: 2569 - DNA, 561 bp, Artificial Sequence; identical to SEQ ID NO: 81
  Description of Artificial Sequence: Synthetic Destabilizing Domain (DD)

SEQ ID NO: 2570 - DNA, 561 bp, Artificial Sequence; identical to SEQ ID NO: 76
  Description of Artificial Sequence: Synthetic Destabilizing Domain (DD)

SEQ ID NO: 2571 - DNA, 561 bp, Artificial Sequence; identical to SEQ ID NO: 84
  Description of Artificial Sequence: Synthetic Destabilizing Domain (DD)

SEQ ID NO: 2572 - DNA, 561 bp, Artificial Sequence; identical to SEQ ID NO: 91
  Description of Artificial Sequence: Synthetic Destabilizing Domain (DD)

SEQ ID NO: 2573 - DNA, 561 bp, Artificial Sequence; identical to SEQ ID NO: 92
  Description of Artificial Sequence: Synthetic Destabilizing Domain (DD)

SEQ ID NO: 2574 - DNA, 561 bp, Artificial Sequence; identical to SEQ ID NO: 93
  Description of Artificial Sequence: Synthetic Destabilizing Domain (DD)

SEQ ID NO: 2575 - DNA, 561 bp, Artificial Sequence; identical to SEQ ID NO: 94
  Description of Artificial Sequence: Synthetic Destabilizing Domain (DD)

SEQ ID NO: 2576 - DNA, 561 bp, Artificial Sequence; identical to SEQ ID NO: 95
  Description of Artificial Sequence: Synthetic Destabilizing Domain (DD)

SEQ ID NO: 2577 - DNA, 561 bp, Artificial Sequence; identical to SEQ ID NO: 96
  Description of Artificial Sequence: Synthetic Destabilizing Domain (DD)

SEQ ID NO: 2578 - DNA, 561 bp, Artificial Sequence; identical to SEQ ID NO: 97
  Description of Artificial Sequence: Synthetic Destabilizing Domain (DD)

SEQ ID NO: 2579 - DNA, 561 bp, Artificial Sequence; identical to SEQ ID NO: 98
  Description of Artificial Sequence: Synthetic Destabilizing Domain (DD)

SEQ ID NO: 2580 - DNA, 561 bp, Artificial Sequence; identical to SEQ ID NO: 99
  Description of Artificial Sequence: Synthetic Destabilizing Domain (DD)

SEQ ID NO: 2581 - DNA, 561 bp, Artificial Sequence; identical to SEQ ID NO: 100
  Description of Artificial Sequence: Synthetic Destabilizing Domain (DD)

SEQ ID NO: 2582 - DNA, 561 bp, Artificial Sequence; identical to SEQ ID NO: 101
  Description of Artificial Sequence: Synthetic Destabilizing Domain (DD)

SEQ ID NO: 2583 - DNA, 561 bp, Artificial Sequence; identical to SEQ ID NO: 102
  Description of Artificial Sequence: Synthetic Destabilizing Domain (DD)

SEQ ID NO: 2584 - DNA, 561 bp, Artificial Sequence; identical to SEQ ID NO: 103
  Description of Artificial Sequence: Synthetic Destabilizing Domain (DD)

SEQ ID NO: 2585 - DNA, 561 bp, Artificial Sequence; identical to SEQ ID NO: 104
  Description of Artificial Sequence: Synthetic Destabilizing Domain (DD)

SEQ ID NO: 2586 - DNA, 561 bp, Artificial Sequence; identical to SEQ ID NO: 105
  Description of Artificial Sequence: Synthetic Destabilizing Domain (DD)

SEQ ID NO: 2587 - DNA, 561 bp, Artificial Sequence; identical to SEQ ID NO: 106
  Description of Artificial Sequence: Synthetic Destabilizing Domain (DD)

SEQ ID NO: 2588 - DNA, 561 bp, Artificial Sequence; identical to SEQ ID NO: 107
  Description of Artificial Sequence: Synthetic Destabilizing Domain (DD)

SEQ ID NO: 2589 - DNA, 561 bp, Artificial Sequence; identical to SEQ ID NO: 108
  Description of Artificial Sequence: Synthetic Destabilizing Domain (DD)

SEQ ID NO: 2590 - DNA, 561 bp, Artificial Sequence; identical to SEQ ID NO: 109
  Description of Artificial Sequence: Synthetic Destabilizing Domain (DD)

SEQ ID NO: 2591 - DNA, 561 bp, Artificial Sequence; identical to SEQ ID NO: 110
  Description of Artificial Sequence: Synthetic Destabilizing Domain (DD)

SEQ ID NO: 2592 - DNA, 561 bp, Artificial Sequence; identical to SEQ ID NO: 111
  Description of Artificial Sequence: Synthetic Destabilizing Domain (DD)

SEQ ID NO: 2593 - DNA, 561 bp, Artificial Sequence; identical to SEQ ID NO: 112
  Description of Artificial Sequence: Synthetic Destabilizing Domain (DD)

SEQ ID NO: 2594 - DNA, 561 bp, Artificial Sequence; identical to SEQ ID NO: 113
  Description of Artificial Sequence: Synthetic Destabilizing Domain (DD)

SEQ ID NO: 2595 - DNA, 561 bp, Artificial Sequence; identical to SEQ ID NO: 114
  Description of Artificial Sequence: Synthetic Destabilizing Domain (DD)

SEQ ID NO: 2596 - DNA, 561 bp, Artificial Sequence; identical to SEQ ID NO: 115
  Description of Artificial Sequence: Synthetic Destabilizing Domain (DD)

SEQ ID NO: 2597 - DNA, 561 bp, Artificial Sequence; identical to SEQ ID NO: 116
  Description of Artificial Sequence: Synthetic Destabilizing Domain (DD)

SEQ ID NO: 2598 - DNA, 561 bp, Artificial Sequence; identical to SEQ ID NO: 117
  Description of Artificial Sequence: Synthetic Destabilizing Domain (DD)

SEQ ID NO: 2599 - DNA, 561 bp, Artificial Sequence; identical to SEQ ID NO: 118
  Description of Artificial Sequence: Synthetic Destabilizing Domain (DD)

SEQ ID NO: 2600 - DNA, 561 bp, Artificial Sequence; identical to SEQ ID NO: 119
  Description of Artificial Sequence: Synthetic Destabilizing Domain (DD)

SEQ ID NO: 2601 - DNA, 561 bp, Artificial Sequence; identical to SEQ ID NO: 120
  Description of Artificial Sequence: Synthetic Destabilizing Domain (DD)

SEQ ID NO: 2602 - DNA, 561 bp, Artificial Sequence; identical to SEQ ID NO: 121
  Description of Artificial Sequence: Synthetic Destabilizing Domain (DD)

SEQ ID NO: 2603 - DNA, 561 bp, Artificial Sequence; identical to SEQ ID NO: 122
  Description of Artificial Sequence: Synthetic Destabilizing Domain (DD)

SEQ ID NO: 2604 - DNA, 561 bp, Artificial Sequence; identical to SEQ ID NO: 123
  Description of Artificial Sequence: Synthetic Destabilizing Domain (DD)

SEQ ID NO: 2605 - DNA, 561 bp, Artificial Sequence; identical to SEQ ID NO: 124
  Description of Artificial Sequence: Synthetic Destabilizing Domain (DD)

SEQ ID NO: 2606 - DNA, 558 bp, Artificial Sequence; identical to SEQ ID NO: 125
  Description of Artificial Sequence: Synthetic Destabilizing Domain (DD)

SEQ ID NO: 2607 - DNA, 558 bp, Artificial Sequence; identical to SEQ ID NO: 1685
  Description of Artificial Sequence: Synthetic Destabilizing Domain (DD)

SEQ ID NO: 2608 - DNA, 1959 bp, Artificial Sequence; identical to SEQ ID NO: 1822
  Description of Artificial Sequence: Synthetic Construct

SEQ ID NO: 2609 - DNA, 1962 bp, Artificial Sequence; identical to SEQ ID NO: 1824
  Description of Artificial Sequence: Synthetic Construct

SEQ ID NO: 2610 - DNA, 1971 bp, Artificial Sequence; identical to SEQ ID NO: 1826
  Description of Artificial Sequence: Synthetic Construct

SEQ ID NO: 2611 - DNA, 1968 bp, Artificial Sequence; identical to SEQ ID NO: 1828
  Description of Artificial Sequence: Synthetic Construct

SEQ ID NO: 2612 - DNA, 1956 bp, Artificial Sequence; identical to SEQ ID NO: 1830
  Description of Artificial Sequence: Synthetic Construct

SEQ ID NO: 2613 - DNA, 1623 bp, Artificial Sequence; identical to SEQ ID NO: 172
  Description of Artificial Sequence: Synthetic Construct

SEQ ID NO: 2614 - DNA, 2130 bp, Artificial Sequence; identical to SEQ ID NO: 1834
  Description of Artificial Sequence: Synthetic Construct

SEQ ID NO: 2615 - DNA, 2214 bp, Artificial Sequence; identical to SEQ ID NO: 173
  Description of Artificial Sequence: Synthetic Construct

SEQ ID NO: 2616 - DNA, 1980 bp, Artificial Sequence; identical to SEQ ID NO: 1838
  Description of Artificial Sequence: Synthetic Construct

SEQ ID NO: 2617 - DNA, 405 bp, Artificial Sequence; identical to SEQ ID NO: 1857
  Description of Artificial Sequence: Synthetic polynucleotide

SEQ ID NO: 2618 - DNA, 912 bp, Artificial Sequence; identical to SEQ ID NO: 1859
  Description of Artificial Sequence: Synthetic polynucleotide

SEQ ID NO: 2619 - DNA, 432 bp, Artificial Sequence; identical to SEQ ID NO: 1861
  Description of Artificial Sequence: Synthetic polynucleotide

SEQ ID NO: 2620 - DNA, 1170 bp, Artificial Sequence; identical to SEQ ID NO: 1863
  Description of Artificial Sequence: Synthetic polynucleotide

SEQ ID NO: 2621 - DNA, 1734 bp, Artificial Sequence; identical to SEQ ID NO: 1865
  Description of Artificial Sequence: Synthetic polynucleotide

SEQ ID NO: 2622 - DNA, 477 bp, Artificial Sequence; identical to SEQ ID NO: 1682
  Description of Artificial Sequence: Synthetic Destabilizing Domain (DD)

SEQ ID NO: 2623 - DNA, 474 bp, Artificial Sequence; identical to SEQ ID NO: 1683
  Description of Artificial Sequence: Synthetic Destabilizing Domain (DD)

SEQ ID NO: 2624 - DNA, 474 bp, Artificial Sequence; identical to SEQ ID NO: 1684
  Description of Artificial Sequence: Synthetic Destabilizing Domain (DD)

SEQ ID NO: 2625 - DNA, 561 bp, Artificial Sequence; identical to SEQ ID NO: 82
  Description of Artificial Sequence: Synthetic Destabilizing Domain (DD)

SEQ ID NO: 2626 - DNA, 561 bp, Artificial Sequence; identical to SEQ ID NO: 83
  Description of Artificial Sequence: Synthetic Destabilizing Domain (DD)

SEQ ID NO: 2627 - DNA, 561 bp, Artificial Sequence; identical to SEQ ID NO: 76
  Description of Artificial Sequence: Synthetic Destabilizing Domain (DD)

SEQ ID NO: 2628 - DNA, 561 bp, Artificial Sequence; identical to SEQ ID NO: 77
  Description of Artificial Sequence: Synthetic Destabilizing Domain (DD)

SEQ ID NO: 2629 - DNA, 561 bp, Artificial Sequence; identical to SEQ ID NO: 84
  Description of Artificial Sequence: Synthetic Destabilizing Domain (DD)

SEQ ID NO: 2630 - DNA, 561 bp, Artificial Sequence; identical to SEQ ID NO: 85
  Description of Artificial Sequence: Synthetic Destabilizing Domain (DD)

SEQ ID NO: 2631 - DNA, 558 bp, Artificial Sequence; identical to SEQ ID NO: 86
  Description of Artificial Sequence: Synthetic Destabilizing Domain (DD)

SEQ ID NO: 2632 - DNA, 561 bp, Artificial Sequence; identical to SEQ ID NO: 74
  Description of Artificial Sequence: Synthetic Destabilizing Domain (DD)

SEQ ID NO: 2633 - DNA, 561 bp, Artificial Sequence; identical to SEQ ID NO: 80
  Description of Artificial Sequence: Synthetic Destabilizing Domain (DD)

SEQ ID NO: 2634 - DNA, 561 bp, Artificial Sequence; identical to SEQ ID NO: 78
  Description of Artificial Sequence: Synthetic Destabilizing Domain (DD)

SEQ ID NO: 2635 - DNA, 561 bp, Artificial Sequence; identical to SEQ ID NO: 81
  Description of Artificial Sequence: Synthetic Destabilizing Domain (DD)

SEQ ID NO: 2636 - DNA, 561 bp, Artificial Sequence; identical to SEQ ID NO: 90
  Description of Artificial Sequence: Synthetic Destabilizing Domain (DD)

SEQ ID NO: 2637 - DNA, 561 bp, Artificial Sequence; identical to SEQ ID NO: 91
  Description of Artificial Sequence: Synthetic Destabilizing Domain (DD)

SEQ ID NO: 2638 - DNA, 561 bp, Artificial Sequence; identical to SEQ ID NO: 92
  Description of Artificial Sequence: Synthetic Destabilizing Domain (DD)

SEQ ID NO: 2639 - DNA, 561 bp, Artificial Sequence; identical to SEQ ID NO: 93
  Description of Artificial Sequence: Synthetic Destabilizing Domain (DD)

SEQ ID NO: 2640 - DNA, 561 bp, Artificial Sequence; identical to SEQ ID NO: 94
  Description of Artificial Sequence: Synthetic Destabilizing Domain (DD)

SEQ ID NO: 2641 - DNA, 561 bp, Artificial Sequence; identical to SEQ ID NO: 95
  Description of Artificial Sequence: Synthetic Destabilizing Domain (DD)

SEQ ID NO: 2642 - DNA, 561 bp, Artificial Sequence; identical to SEQ ID NO: 96
  Description of Artificial Sequence: Synthetic Destabilizing Domain (DD)

SEQ ID NO: 2643 - DNA, 561 bp, Artificial Sequence; identical to SEQ ID NO: 97
  Description of Artificial Sequence: Synthetic Destabilizing Domain (DD)

SEQ ID NO: 2644 - DNA, 561 bp, Artificial Sequence; identical to SEQ ID NO: 98
  Description of Artificial Sequence: Synthetic Destabilizing Domain (DD)

SEQ ID NO: 2645 - DNA, 561 bp, Artificial Sequence; identical to SEQ ID NO: 99
  Description of Artificial Sequence: Synthetic Destabilizing Domain (DD)

SEQ ID NO: 2646 - DNA, 561 bp, Artificial Sequence; identical to SEQ ID NO: 100
  Description of Artificial Sequence: Synthetic Destabilizing Domain (DD)

SEQ ID NO: 2647 - DNA, 561 bp, Artificial Sequence; identical to SEQ ID NO: 101
  Description of Artificial Sequence: Synthetic Destabilizing Domain (DD)

SEQ ID NO: 2648 - DNA, 561 bp, Artificial Sequence; identical to SEQ ID NO: 102
  Description of Artificial Sequence: Synthetic Destabilizing Domain (DD)

SEQ ID NO: 2649 - DNA, 561 bp, Artificial Sequence; identical to SEQ ID NO: 103
  Description of Artificial Sequence: Synthetic Destabilizing Domain (DD)

SEQ ID NO: 2650 - DNA, 561 bp, Artificial Sequence; identical to SEQ ID NO: 104
  Description of Artificial Sequence: Synthetic Destabilizing Domain (DD)

SEQ ID NO: 2651 - DNA, 561 bp, Artificial Sequence; identical to SEQ ID NO: 105
  Description of Artificial Sequence: Synthetic Destabilizing Domain (DD)

SEQ ID NO: 2652 - DNA, 561 bp, Artificial Sequence; identical to SEQ ID NO: 106
  Description of Artificial Sequence: Synthetic Destabilizing Domain (DD)

SEQ ID NO: 2653 - DNA, 561 bp, Artificial Sequence; identical to SEQ ID NO: 107
  Description of Artificial Sequence: Synthetic Destabilizing Domain (DD)

SEQ ID NO: 2654 - DNA, 561 bp, Artificial Sequence; identical to SEQ ID NO: 108
  Description of Artificial Sequence: Synthetic Destabilizing Domain (DD)

SEQ ID NO: 2655 - DNA, 561 bp, Artificial Sequence; identical to SEQ ID NO: 109
  Description of Artificial Sequence: Synthetic Destabilizing Domain (DD)

SEQ ID NO: 2656 - DNA, 561 bp, Artificial Sequence; identical to SEQ ID NO: 110
  Description of Artificial Sequence: Synthetic Destabilizing Domain (DD)

SEQ ID NO: 2657 - DNA, 561 bp, Artificial Sequence; identical to SEQ ID NO: 111
  Description of Artificial Sequence: Synthetic Destabilizing Domain (DD)

SEQ ID NO: 2658 - DNA, 561 bp, Artificial Sequence; identical to SEQ ID NO: 112
  Description of Artificial Sequence: Synthetic Destabilizing Domain (DD)

SEQ ID NO: 2659 - DNA, 561 bp, Artificial Sequence; identical to SEQ ID NO: 113
  Description of Artificial Sequence: Synthetic Destabilizing Domain (DD)

SEQ ID NO: 2660 - DNA, 561 bp, Artificial Sequence; identical to SEQ ID NO: 114
  Description of Artificial Sequence: Synthetic Destabilizing Domain (DD)

SEQ ID NO: 2661 - DNA, 561 bp, Artificial Sequence; identical to SEQ ID NO: 115
  Description of Artificial Sequence: Synthetic Destabilizing Domain (DD)

SEQ ID NO: 2662 - DNA, 561 bp, Artificial Sequence; identical to SEQ ID NO: 116
  Description of Artificial Sequence: Synthetic Destabilizing Domain (DD)

SEQ ID NO: 2663 - DNA, 561 bp, Artificial Sequence; identical to SEQ ID NO: 117
  Description of Artificial Sequence: Synthetic Destabilizing Domain (DD)

SEQ ID NO: 2664 - DNA, 561 bp, Artificial Sequence; identical to SEQ ID NO: 118
  Description of Artificial Sequence: Synthetic Destabilizing Domain (DD)

SEQ ID NO: 2665 - DNA, 561 bp, Artificial Sequence; identical to SEQ ID NO: 119
  Description of Artificial Sequence: Synthetic Destabilizing Domain (DD)

SEQ ID NO: 2666 - DNA, 561 bp, Artificial Sequence; identical to SEQ ID NO: 120
  Description of Artificial Sequence: Synthetic Destabilizing Domain (DD)

SEQ ID NO: 2667 - DNA, 561 bp, Artificial Sequence; identical to SEQ ID NO: 121
  Description of Artificial Sequence: Synthetic Destabilizing Domain (DD)

SEQ ID NO: 2668 - DNA, 561 bp, Artificial Sequence; identical to SEQ ID NO: 122
  Description of Artificial Sequence: Synthetic Destabilizing Domain (DD)

SEQ ID NO: 2669 - DNA, 561 bp, Artificial Sequence; identical to SEQ ID NO: 123
  Description of Artificial Sequence: Synthetic Destabilizing Domain (DD)

SEQ ID NO: 2670 - DNA, 561 bp, Artificial Sequence; identical to SEQ ID NO: 124
  Description of Artificial Sequence: Synthetic Destabilizing Domain (DD)

SEQ ID NO: 2671 - DNA, 558 bp, Artificial Sequence; identical to SEQ ID NO: 125
  Description of Artificial Sequence: Synthetic Destabilizing Domain (DD)

SEQ ID NO: 2672 - DNA, 558 bp, Artificial Sequence; identical to SEQ ID NO: 126
  Description of Artificial Sequence: Synthetic Destabilizing Domain (DD)

SEQ ID NO: 2673 - DNA, 561 bp, Artificial Sequence; identical to SEQ ID NO: 1944
  Description of Artificial Sequence: Synthetic Destabilizing Domain (DD)

SEQ ID NO: 2674 - DNA, 561 bp, Artificial Sequence; identical to SEQ ID NO: 1944
  Description of Artificial Sequence: Synthetic Destabilizing Domain (DD)

SEQ ID NO: 2675 - DNA, 558 bp, Artificial Sequence; identical to SEQ ID NO: 1943
  Description of Artificial Sequence: Synthetic Destabilizing Domain (DD)

SEQ ID NO: 2676 - DNA, 561 bp, Artificial Sequence; identical to SEQ ID NO: 1688
  Description of Artificial Sequence: Synthetic Destabilizing Domain (DD)

SEQ ID NO: 2677 - DNA, 558 bp, Artificial Sequence; identical to SEQ ID NO: 1689
  Description of Artificial Sequence: Synthetic Destabilizing Domain (DD)

SEQ ID NO: 2678 - DNA, 558 bp, Artificial Sequence; identical to SEQ ID NO: 1690
  Description of Artificial Sequence: Synthetic Destabilizing Domain (DD)

SEQ ID NO: 2679 - DNA, 561 bp, Artificial Sequence; identical to SEQ ID NO: 1694
  Description of Artificial Sequence: Synthetic Destabilizing Domain (DD)

SEQ ID NO: 2680 - DNA, 558 bp, Artificial Sequence; identical to SEQ ID NO: 1695
  Description of Artificial Sequence: Synthetic Destabilizing Domain (DD)

SEQ ID NO: 2681 - DNA, 558 bp, Artificial Sequence; identical to SEQ ID NO: 1696
  Description of Artificial Sequence: Synthetic Destabilizing Domain (DD)

SEQ ID NO: 2682 - DNA, 558 bp, Artificial Sequence; identical to SEQ ID NO: 1946
  Description of Artificial Sequence: Synthetic Destabilizing Domain (DD)

SEQ ID NO: 2683 - DNA, 558 bp, Artificial Sequence; identical to SEQ ID NO: 1948
  Description of Artificial Sequence: Synthetic Destabilizing Domain (DD)

SEQ ID NO: 2684 - DNA, 558 bp, Artificial Sequence; identical to SEQ ID NO: 1820
  Description of Artificial Sequence: Synthetic Destabilizing Domain (DD)

SEQ ID NO: 2685 - DNA, 936 bp, Artificial Sequence
  Description of Artificial Sequence: Synthetic Construct
atgacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaa

SEQ ID NO: 2686 - DNA, 1983 bp, Artificial Sequence
  Description of Artificial Sequence: Synthetic Construct
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgaggagttcatggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagagcaagctgtga

SEQ ID NO: 2687 - DNA, 1263 bp, Artificial Sequence
  Description of Artificial Sequence: Synthetic Construct
atgggcgtgcaggttgagactataagcccaggcgacggcaggaccttccccaagaggggccagacatgcgtggtgcactacaccggcatgcttgaagacggcaaaaaggtggactcaagcagggacaggaacaagcccttcaagttcatgttgggcaaacaggaggtgatcagaggctgggaggagggtgttgcccagatgagcgtggggcagagggccaagctcacgataagtcccgattacgcctacggcgccaccggtcaccccggcatcatccccccacacgccaccctggtgttcgacgtggaattgctgaagcccgagagcggcacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaa

SEQ ID NO: 2688 - DNA, 1416 bp, Artificial Sequence
  Description of Artificial Sequence: Synthetic Construct
atgatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgtagcggcacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagtaa

SEQ ID NO: 2689 - DNA, 1263 bp, Artificial Sequence
  Description of Artificial Sequence: Synthetic Construct
atgacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagagcggcggcgtgcaggttgagactataagcccaggcgacggcaggaccttccccaagaggggccagacatgcgtggtgcactacaccggcatgcttggcgacggcaaaaaggtggactcaagcagggacaggaacaagcccttcaagttcatgttgggcaaacaggaggtgatcagaggctgggaggagggtgttgcccagatgagcgtggggcagggcgccaagctcacgataagtcccgattacgcctacggcgccaccggtcaccccggcatcatccccccacacgccaccctggtgttcgacgtggaattgctggagctggagtga

SEQ ID NO: 2690 - protein, 557 aa, Homo sapiens
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 2691 - protein, 556 aa, Homo sapiens [sequence omitted]

SEQ ID NO: 2692 - protein, 557 aa, Macaca mulatta
MPPPCLLFFLLFLTPMEVRPQEPLVVKVEEGDNAVLQCLEGTSDGPTQQLVWCRDSPFEPFLNLSLGLPGMGIRMGPLGIWLLIFNVSNQTGGFYLCQPGLPSEKAWQPGWTVSVEGSGELFRWNVSDLGGLGCGLKNRSSEGPSSPSGKLNSSQLYVWAKDRPEMWEGEPVCGPPRDSLNQSLSQDLTMAPGSTLWLSCGVPPDSVSRGPLSWTHVRPKGPKSSLLSLELKDDRPDRDMWVVDTGLLLTRATAQDAGKYYCHRGNWTKSFYLEITARPALWHWLLRIGGWKVPAVTLTYLIFCLCSLVGILQLQRALVLRRKRKRMTDPTRRFFKVTPPPGSGPQNQYGNVLSLPTPTSGLGRAQRWAAGLGGTAPSYGNPSSDVQVDGAVGSRSPPGAGPEEEEGEGYEEPDSEEGSEFYENDSNFGQDQLSQDGSGYENPEDEPLGPEDEDSFSNAESYENEDEELTQPVARTMDFLSPHGSAWDPSREATSLGSQSYEDMRGLLYAAPQLRTIRGQPGPNHEEDADSYENMDNPDGPDPAWGGGGRMGTWSAR

SEQ ID NO: 2693 - protein, 557 aa, Artificial Sequence
  Description of Artificial Sequence: Synthetic CD19 mutant
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVRPKGPKSLLSLELKDDRPDRDMWVVDTGLLLTRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 2694 - protein, 557 aa, Artificial Sequence
  Description of Artificial Sequence: Synthetic CD19 mutant
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVRPKGPKSLLSLELKDDRPDRDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 2695 - protein, 467 aa, Artificial Sequence
  Description of Artificial Sequence: Synthetic CD19 mutant
MPPPRLLFFLLFLTPMEVRPEEPLVVKVEGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 2696 - protein, 278 aa, Artificial Sequence
  Description of Artificial Sequence: Synthetic CD19 mutant
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARP

SEQ ID NO: 2697 - protein, 189 aa, Artificial Sequence
  Description of Artificial Sequence: Synthetic CD19 mutant
MPPPRLLFFLLFLTPMEVRPEEPLVVKVEGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARP

SEQ ID NO: 2698 - protein, 311 aa, Renilla reniformis
MTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 2699 - DNA, 936 bp, Renilla reniformis; identical to SEQ ID NO: 2685

SEQ ID NO: 2700 - protein, 550 aa, Photinus pyralis
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKSKL

SEQ ID NO: 2701 - DNA, 1653 bp, Photinus pyralis
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagagcaagctgtga

SEQ ID NO: 2702 - DNA, 10 bp, Artificial Sequence
  Description of Artificial Sequence: Synthetic oligonucleotide
  First 6 nucleotide sequences only
  modified_base (7)..(10): a, c, t or g
gagtccnnnn

SEQ ID NO: 2703 - DNA, 10 bp, Artificial Sequence
  Description of Artificial Sequence: Synthetic oligonucleotide
  First 6 nucleotides only
  modified_base (7)..(10): a, c, t or g
agcggcnnnn

SEQ ID NO: 2704 - protein, 311 aa, Renilla reniformis; identical to SEQ ID NO: 2698

SEQ ID NO: 2705 - DNA, 936 bp, Renilla reniformis; identical to SEQ ID NO: 2685

SEQ ID NO: 2706 - protein, 550 aa, Photinus pyralis; identical to SEQ ID NO: 2700

SEQ ID NO: 2707 - DNA, 1653 bp, Photinus pyralis; identical to SEQ ID NO: 2701

SEQ ID NO: 2708 - protein, 311 aa, Artificial Sequence; identical to SEQ ID NO: 2698
  Description of Artificial Sequence: Synthetic Construct

SEQ ID NO: 2709 - protein, 660 aa, Artificial Sequence
  Description of Artificial Sequence: Synthetic Construct
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEEFMEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKSKL

SEQ ID NO: 2710 - protein, 420 aa, Artificial Sequence
  Description of Artificial Sequence: Synthetic Construct
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPESGTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 2711 - protein, 471 aa, Artificial Sequence
  Description of Artificial Sequence: Synthetic Construct
MISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERRSGTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 2712 - protein, 420 aa, Artificial Sequence
  Description of Artificial Sequence: Synthetic Construct
MTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQSGGVQVETISPGDGRTFPKRGQTCVVHYTGMLGDGKKVDSSRDRNKPFKFMLGKQEVIRGWEEGVAQMSVGQGAKLTISPDYAYGATGHPGIIPPHATLVFDVELLELE

SEQ ID NO: 2713 - protein, 471 aa, Artificial Sequence
  Description of Artificial Sequence: Synthetic Construct
MTSKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQSGISLIAALAVDYVIGMENAMPWNLPADLAWFKRNTLNKPVIMGRHTWESIGRPLPGRKNIILSSQPGTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 2714 - DNA, 1335 bp, Artificial Sequence; identical to SEQ ID NO: 1798
  Description of Artificial Sequence: Synthetic promoter

SEQ ID NO: 2715 - DNA, 399 bp, Artificial Sequence; identical to SEQ ID NO: 1797
  Description of Artificial Sequence: Synthetic promoter

SEQ ID NO: 2716 - DNA, 1339 bp, Artificial Sequence; identical to SEQ ID NO: 1796
  Description of Artificial Sequence: Synthetic promoter

SEQ ID NO: 2717 - DNA, 600 bp, Artificial Sequence
  Description of Artificial Sequence: Synthetic promoter
aagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctact

SEQ ID NO: 2718 - DNA, 603 bp, Artificial Sequence; identical to SEQ ID NO: 1795
  Description of Artificial Sequence: Synthetic promoter

SEQ ID NO: 2719 - DNA, 399 bp, Artificial Sequence; identical to SEQ ID NO: 1797
  Description of Artificial Sequence: Synthetic promoter

SEQ ID NO: 2720 - DNA, 1339 bp, Artificial Sequence; identical to SEQ ID NO: 1796
  Description of Artificial Sequence: Synthetic promoter

SEQ ID NO: 2721 - DNA, 1335 bp, Artificial Sequence; identical to SEQ ID NO: 1798
  Description of Artificial Sequence: Synthetic promoter

SEQ ID NO: 2722 - DNA, 21 bp, Artificial Sequence
  Description of Artificial Sequence: Synthetic forward primer
gaattcctcgaggccaccatg

SEQ ID NO: 2723 - DNA, 20 bp, Artificial Sequence
  Description of Artificial Sequence: Synthetic reverse primer
ccaccagagccaccactagt

SEQ ID NO: 2724 - protein, 158 aa, Artificial Sequence; identical to SEQ ID NO: 1174
  Description of Artificial Sequence: Synthetic destabilizing domain (DD)

SEQ ID NO: 2725 - protein, 239 aa, Artificial Sequence; identical to SEQ ID NO: 1181
  Description of Artificial Sequence: Synthetic polypeptide

SEQ ID NO: 2726 - DNA, 561 bp, Artificial Sequence; identical to SEQ ID NO: 90
  Description of Artificial Sequence: Synthetic Destabilizing Domain (DD)

SEQ ID NO: 2727 - DNA, 1416 bp, Artificial Sequence
  Description of Artificial Sequence: Synthetic Construct
atgacttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcagagcggcatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgttga

SEQ ID NO: 2728 - protein, 6 aa, Artificial Sequence
  Description of Artificial Sequence: Synthetic peptide
GGSGGG

SEQ ID NO: 2729 - protein, 5 aa, Artificial Sequence
  Description of Artificial Sequence: Synthetic peptide
GGSGG

SEQ ID NO: 2730 - protein, 26 aa, Artificial Sequence
  Description of Artificial Sequence: Synthetic peptide
SGGGSGGGGSGGGGSGGGGSGGGSLQ

SEQ ID NO: 2731 - protein, 15 aa, Artificial Sequence
  Description of Artificial Sequence: Synthetic peptide
GGGGSGGGGSGGGGS

SEQ ID NO: 2732 - protein, 9 aa, Artificial Sequence
  Description of Artificial Sequence: Synthetic peptide
SARNRQKRS

SEQ ID NO: 2733 - protein, 8 aa, Artificial Sequence
  Description of Artificial Sequence: Synthetic peptide
ARNRQKRS

SEQ ID NO: 2734 - protein, 12 aa, Artificial Sequence
  Description of Artificial Sequence: Synthetic peptide
ESRRVRRNKRSK

SEQ ID NO: 2735 - protein, 4 aa, Artificial Sequence
  Description of Artificial Sequence: Synthetic peptide
GGSG

SEQ ID NO: 2736 - DNA, 21 bp, Artificial Sequence
  Description of Artificial Sequence: Synthetic primer
gaattcctcgaggccaccatg

SEQ ID NO: 2737 - DNA, 20 bp, Artificial Sequence
  Description of Artificial Sequence: Synthetic primer
ccaccagagccaccactagt

SEQ ID NO: 2738 - protein, 434 aa, Artificial Sequence; identical to SEQ ID NO: 1186
  Description of Artificial Sequence: Synthetic polypeptide

SEQ ID NO: 2739 - protein, 110 aa, Homo sapiens
RRHQGKQNELSDTAGREINLVDAHLKSEQTEASTRQNSQVLLSETGIYDNDPDLCFRMQEGSEVYSNPCLEENKPGVYASLNHSVIGPNSRLARNVKEAPTEYASICVRS

SEQ ID NO: 2740 - protein, 13 aa, Artificial Sequence
  Description of Artificial Sequence: Synthetic peptide
GGGGSGGGSGGGS

SEQ ID NO: 2741 - protein, 234 aa, Homo sapiens; identical to SEQ ID NO: 634
  MOD_RES (91)..(91): Selenocysteine

SEQ ID NO: 2742 - protein, 415 aa, Homo sapiens; identical to SEQ ID NO: 744

SEQ ID NO: 2743 - protein, 22 aa, Artificial Sequence
  Description of Artificial Sequence: Synthetic peptide
MLLLVTSLLLCELPHPAFLLIP

SEQ ID NO: 2744 - protein, 8 aa, Artificial Sequence
  Description of Artificial Sequence: Synthetic peptide
DYKDDDDK

SEQ ID NO: 2745 - protein, 186 aa, Artificial Sequence; identical to SEQ ID NO: 71
  Description of Artificial Sequence: Synthetic polypeptide

SEQ ID NO: 2746 - protein, 69 aa, Homo sapiens; identical to SEQ ID NO: 607

SEQ ID NO: 2747 - protein, 21 aa, Homo sapiens
MALPVTALLLPLALLLHAARP

SEQ ID NO: 2748 - protein, 22 aa, Homo sapiens
MCHQQLVISWFSLVFLASPLVA

SEQ ID NO: 2749 - protein, 306 aa, Homo sapiens; identical to SEQ ID NO: 734

SEQ ID NO: 2750 - protein, 197 aa, Homo sapiens; identical to SEQ ID NO: 735

SEQ ID NO: 2751 - protein, 114 aa, Homo sapiens; identical to SEQ ID NO: 718

SEQ ID NO: 2752 - protein, 237 aa, Homo sapiens; identical to SEQ ID NO: 724

SEQ ID NO: 2753 - protein, 235 aa, Artificial Sequence; identical to SEQ ID NO: 1625
  Description of Artificial Sequence: Synthetic polypeptide

SEQ ID NO: 2754 - protein, 5 aa, Artificial Sequence
  Description of Artificial Sequence: Synthetic peptide
GGSGG

SEQ ID NO: 2755 - protein, 15 aa, Artificial Sequence
  Description of Artificial Sequence: Synthetic peptide
GGGGSGGGGSGGGGS

SEQ ID NO: 2756 - protein, 4 aa, Artificial Sequence
  Description of Artificial Sequence: Synthetic peptide
GGSG

SEQ ID NO: 2757 - protein, 22 aa, Artificial Sequence
  Description of Artificial Sequence: Synthetic peptide
MLLLVTSLLLCELPHPAFLLIP

SEQ ID NO: 2758 - protein, 26 aa, Artificial Sequence
  Description of Artificial Sequence: Synthetic peptide
SGGGSGGGGSGGGGSGGGGSGGGSLQ

SEQ ID NO: 2759 - protein, 12 aa, Artificial Sequence
  Description of Artificial Sequence: Synthetic peptide
ESRRVRRNKRSK

SEQ ID NO: 2760 - DNA, 32 bp, Artificial Sequence; identical to SEQ ID NO: 1659
  Description of Artificial Sequence: Synthetic oligonucleotide

SEQ ID NO: 2761 - protein, 6 aa, Artificial Sequence
  Description of Artificial Sequence: Synthetic peptide
EFSTEF

SEQ ID NO: 2762 - protein, 21 aa, Artificial Sequence
  Description of Artificial Sequence: Synthetic peptide
LLLVTSLLLCELPHPAFLLIP

SEQ ID NO: 2763 - protein, 4 aa, Artificial Sequence
  Description of Artificial Sequence: Synthetic peptide
ASFE

SEQ ID NO: 2764 - protein, 42 aa, Homo sapiens; identical to SEQ ID NO: 426

SEQ ID NO: 2765 - protein, 243 aa, Artificial Sequence; identical to SEQ ID NO: 1732
  Description of Artificial Sequence: Synthetic polypeptide

SEQ ID NO: 2766 - protein, 21 aa, Homo sapiens
MALPVTALLLPLALLLHAARP

SEQ ID NO: 2767 - protein, 45 aa, Homo sapiens; identical to SEQ ID NO: 601

SEQ ID NO: 2768 - protein, 24 aa, Homo sapiens
IYIWAPLAGTCGVLLLSLVITLYC

SEQ ID NO: 2769 - protein, 112 aa, Homo sapiens; identical to SEQ ID NO: 419

SEQ ID NO: 2770 - protein, 186 aa, Artificial Sequence; identical to SEQ ID NO: 13
  Description of Artificial Sequence: Synthetic polypeptide

SEQ ID NO: 2771 - protein, 431 aa, Homo sapiens; identical to SEQ ID NO: 745

SEQ ID NO: 2772 - protein, 246 aa, Artificial Sequence; identical to SEQ ID NO: 1745
  Description of Artificial Sequence: Synthetic polypeptide

SEQ ID NO: 2773 - protein, 69 aa, Homo sapiens; identical to SEQ ID NO: 607

SEQ ID NO: 2774 - protein, 158 aa, Artificial Sequence; identical to SEQ ID NO: 1174
  Description of Artificial Sequence: Synthetic polypeptide

SEQ ID NO: 2775 - protein, 107 aa, Artificial Sequence; identical to SEQ ID NO: 1177
  Description of Artificial Sequence: Synthetic polypeptide

SEQ ID NO: 2776 - protein, 20 aa, Homo sapiens
MYRMQLLSCIALSLALVTNS

SEQ ID NO: 2777 - protein, 6 aa, Artificial Sequence
  Description of Artificial Sequence: Synthetic peptide
EFSTEF

SEQ ID NO: 2778 - protein, 107 aa, Artificial Sequence; identical to SEQ ID NO: 1176
  Description of Artificial Sequence: Synthetic polypeptide

SEQ ID NO: 2779 - protein, 19 aa, Artificial Sequence
  Description of Artificial Sequence: Synthetic peptide
ATNFSLLKQAGDVEENPGP

SEQ ID NO: 2780 - protein, 9 aa, Homo sapiens
SARNRQKRS

SEQ ID NO: 2781 - protein, 8 aa, Homo sapiens
ARNRQKRS

SEQ ID NO: 2782 - protein, 20 aa, Artificial Sequence
  Description of Artificial Sequence: Synthetic peptide
GATNFSLLKQAGDVEENPGP

SEQ ID NO: 2783 - protein, 306 aa, Artificial Sequence; identical to SEQ ID NO: 1807
  Description of Artificial Sequence: Synthetic polypeptide

SEQ ID NO: 2784 - protein, 652 aa, Artificial Sequence; identical to SEQ ID NO: 1821
  Description of Artificial Sequence: Synthetic polypeptide

SEQ ID NO: 2785 - protein, 653 aa, Artificial Sequence; identical to SEQ ID NO: 1823
  Description of Artificial Sequence: Synthetic polypeptide

SEQ ID NO: 2786 - protein, 656 aa, Artificial Sequence; identical to SEQ ID NO: 1825
  Description of Artificial Sequence: Synthetic polypeptide

SEQ ID NO: 2787 - protein, 655 aa, Artificial Sequence; identical to SEQ ID NO: 1827
  Description of Artificial Sequence: Synthetic polypeptide

SEQ ID NO: 2788 - protein, 651 aa, Artificial Sequence; identical to SEQ ID NO: 1829
  Description of Artificial Sequence: Synthetic polypeptide

SEQ ID NO: 2789 - protein, 540 aa, Artificial Sequence; identical to SEQ ID NO: 1831
  Description of Artificial Sequence: Synthetic polypeptide

SEQ ID NO: 2790 - protein, 710 aa, Artificial Sequence; identical to SEQ ID NO: 1833
  Description of Artificial Sequence: Synthetic polypeptide

SEQ ID NO: 2791 - protein, 738 aa, Artificial Sequence; identical to SEQ ID NO: 1835
  Description of Artificial Sequence: Synthetic polypeptide

SEQ ID NO: 2792 - protein, 659 aa, Artificial Sequence; identical to SEQ ID NO: 1837
  Description of Artificial Sequence: Synthetic polypeptide

SEQ ID NO: 2793 - protein, 20 aa, Homo sapiens
MYRMQLLSCIALSLALVTNS

SEQ ID NO: 2794 - protein, 18 aa, Homo sapiens
MDWTWILFLVAAATRVHS

SEQ ID NO: 2795 - protein, 6 aa, Artificial Sequence
  Description of Artificial Sequence: Synthetic peptide
EFSTEF

SEQ ID NO: 2796 - protein, 134 aa, Artificial Sequence; identical to SEQ ID NO: 1856
  Description of Artificial Sequence: Synthetic polypeptide

SEQ ID NO: 2797 - protein, 303 aa, Artificial Sequence; identical to SEQ ID NO: 1858
  Description of Artificial Sequence: Synthetic polypeptide

SEQ ID NO: 2798 - protein, 143 aa, Artificial Sequence; identical to SEQ ID NO: 1860
  Description of Artificial Sequence: Synthetic polypeptide

SEQ ID NO: 2799 - protein, 389 aa, Artificial Sequence; identical to SEQ ID NO: 1862
  Description of Artificial Sequence: Synthetic polypeptide

SEQ ID NO: 2800 - protein, 577 aa, Artificial Sequence; identical to SEQ ID NO: 1864
  Description of Artificial Sequence: Synthetic polypeptide

SEQ ID NO: 2801 - protein, 20 aa, Homo sapiens
MYRMQLLSCIALSLALVTNS

SEQ ID NO: 2802 - protein, 18 aa, Homo sapiens
MDWTWILFLVAAATRVHS

SEQ ID NO: 2803 - protein, 6 aa, Artificial Sequence
  Description of Artificial Sequence: Synthetic peptide
EFSTEF

SEQ ID NO: 2804 - protein, 5 aa, Artificial Sequence
  Description of Artificial Sequence: Synthetic peptide
GGSGG

SEQ ID NO: 2805 - protein, 9 aa, Artificial Sequence
  Description of Artificial Sequence: Synthetic peptide
YPYDVPDYA

SEQ ID NO: 2806 - protein, 20 aa, Artificial Sequence
  Description of Artificial Sequence: Synthetic peptide
GATNFSLLKQAGDVEENPGP

SEQ ID NO: 2807 - protein, 235 aa, Artificial Sequence; identical to SEQ ID NO: 1625
  Description of Artificial Sequence: Synthetic polypeptide

SEQ ID NO: 2808 - protein, 158 aa, Artificial Sequence; identical to SEQ ID NO: 1174
  Description of Artificial Sequence: Synthetic polypeptide

SEQ ID NO: 2809 - protein, 186 aa, Artificial Sequence; identical to SEQ ID NO: 13
  Description of Artificial Sequence: Synthetic polypeptide

SEQ ID NO: 2810 - protein, 134 aa, Artificial Sequence; identical to SEQ ID NO: 1856
  Description of Artificial Sequence: Synthetic polypeptide

SEQ ID NO: 2811 - protein, 303 aa, Artificial Sequence; identical to SEQ ID NO: 1858
  Description of Artificial Sequence: Synthetic polypeptide

SEQ ID NO: 2812 - protein, 143 aa, Artificial Sequence; identical to SEQ ID NO: 1860
  Description of Artificial Sequence: Synthetic polypeptide

SEQ ID NO: 2813 - protein, 389 aa, Artificial Sequence; identical to SEQ ID NO: 1862
  Description of Artificial Sequence: Synthetic polypeptide

SEQ ID NO: 2814 - protein, 577 aa, Artificial Sequence; identical to SEQ ID NO: 1864
  Description of Artificial Sequence: Synthetic polypeptide

SEQ ID NO: 2815 - protein, 30 aa, Homo sapiens; identical to SEQ ID NO: 1919

SEQ ID NO: 2816 - protein, 5 aa, Artificial Sequence
  Description of Artificial Sequence: Synthetic peptide
SGGGS

SEQ ID NO: 2817 - protein, 34 aa, Artificial Sequence; identical to SEQ ID NO: 1924
  Description of Artificial Sequence: Synthetic polypeptide

SEQ ID NO: 2818 - protein, 20 aa, Artificial Sequence
  Description of Artificial Sequence: Synthetic peptide
SGGGSGGGGSGGGGSGGGGS

SEQ ID NO: 2819 - DNA, 28 bp, Artificial Sequence
  Description of Artificial Sequence: Synthetic oligonucleotide
tctagataatacgactcactagagatcc

SEQ ID NO: 2820 - DNA, 16 bp, Artificial Sequence
  Description of Artificial Sequence: Synthetic oligonucleotide
tatggccacaaccatg

SEQ ID NO: 2821 - DNA, 30 bp, Artificial Sequence; identical to SEQ ID NO: 1934
  Description of Artificial Sequence: Synthetic oligonucleotide

SEQ ID NO: 2822 - protein, 175 aa, Homo sapiens; identical to SEQ ID NO: 725

SEQ ID NO: 2823 - protein, 235 aa, Artificial Sequence; identical to SEQ ID NO: 1939
  Description of Artificial Sequence: Synthetic polypeptide

SEQ ID NO: 2824 - protein, 8 aa, Artificial Sequence
  Description of Artificial Sequence: Synthetic peptide
DYKDDDDK

SEQ ID NO: 2825 - protein, 555 aa, Artificial Sequence; identical to SEQ ID NO: 1949
  Description of Artificial Sequence: Synthetic polypeptide

SEQ ID NO: 2826 - protein, 504 aa, Artificial Sequence; identical to SEQ ID NO: 1951
  Description of Artificial Sequence: Synthetic polypeptide

SEQ ID NO: 2827 - protein, 395 aa, Artificial Sequence [sequence omitted]

SEQ ID NO: 2828 - protein, 555 aa, Artificial Sequence; identical to SEQ ID NO: 1955
  Description of Artificial Sequence: Synthetic polypeptide

SEQ ID NO: 2829 - protein, 583 aa, Artificial Sequence; identical to SEQ ID NO: 1957
  Description of Artificial Sequence: Synthetic polypeptide

SEQ ID NO: 2830 - protein, 583 aa, Artificial Sequence; identical to SEQ ID NO: 1959
  Description of Artificial Sequence: Synthetic polypeptide

SEQ ID NO: 2831 - protein, 583 aa, Artificial Sequence; identical to SEQ ID NO: 1961
  Description of Artificial Sequence: Synthetic polypeptide

SEQ ID NO: 2832 - protein, 583 aa, Artificial Sequence; identical to SEQ ID NO: 1963
  Description of Artificial Sequence: Synthetic polypeptide

SEQ ID NO: 2833 - protein, 583 aa, Artificial Sequence; identical to SEQ ID NO: 1965
  Description of Artificial Sequence: Synthetic polypeptide

SEQ ID NO: 2834 - protein, 404 aa, Artificial Sequence; identical to SEQ ID NO: 1967
  Description of Artificial Sequence: Synthetic polypeptide

SEQ ID NO: 2835 - protein, 403 aa, Artificial Sequence; identical to SEQ ID NO: 1969
  Description of Artificial Sequence: Synthetic polypeptide

SEQ ID NO: 2836 - protein, 403 aa, Artificial Sequence; identical to SEQ ID NO: 1971
  Description of Artificial Sequence: Synthetic polypeptide

SEQ ID NO: 2837 - protein, 371 aa, Artificial Sequence; identical to SEQ ID NO: 1973
  Description of Artificial Sequence: Synthetic polypeptide

SEQ ID NO: 2838 - protein, 407 aa, Artificial Sequence; identical to SEQ ID NO: 1975
  Description of Artificial Sequence: Synthetic polypeptide

SEQ ID NO: 2839 - protein, 397 aa, Artificial Sequence; identical to SEQ ID NO: 1977
  Description of Artificial Sequence: Synthetic polypeptide

SEQ ID NO: 2840 - protein, 555 aa, Artificial Sequence; identical to SEQ ID NO: 1955
  Description of Artificial Sequence: Synthetic polypeptide

SEQ ID NO: 2841 - protein, 407 aa, Artificial Sequence; identical to SEQ ID NO: 1975
  Description of Artificial Sequence: Synthetic polypeptide

SEQ ID NO: 2842 - protein, 573 aa, Artificial Sequence; identical to SEQ ID NO: 1984
  Description of Artificial Sequence: Synthetic polypeptide

SEQ ID NO: 2843 - protein, 414 aa, Artificial Sequence; identical to SEQ ID NO: 1986
  Description of Artificial Sequence: Synthetic polypeptide

SEQ ID NO: 2844 - protein, 601 aa, Artificial Sequence; identical to SEQ ID NO: 1988
  Description of Artificial Sequence: Synthetic polypeptide

SEQ ID NO: 2845 - protein, 601 aa, Artificial Sequence; identical to SEQ ID NO: 1990
  Description of Artificial Sequence: Synthetic polypeptide

SEQ ID NO: 2846 - protein, 601 aa, Artificial Sequence; identical to SEQ ID NO: 1992
  Description of Artificial Sequence: Synthetic polypeptide

SEQ ID NO: 2847 - protein, 601 aa, Artificial Sequence; identical to SEQ ID NO: 1994
  Description of Artificial Sequence: Synthetic polypeptide

SEQ ID NO: 2848 - protein, 601 aa, Artificial Sequence; identical to SEQ ID NO: 1996
  Description of Artificial Sequence: Synthetic polypeptide

SEQ ID NO: 2849 - protein, 601 aa, Artificial Sequence; identical to SEQ ID NO: 1998
  Description of Artificial Sequence: Synthetic polypeptide

SEQ ID NO: 2850 - protein, 681 aa, Artificial Sequence; identical to SEQ ID NO: 2000
  Description of Artificial Sequence: Synthetic polypeptide

SEQ ID NO: 2851 - protein, 652 aa, Artificial Sequence; identical to SEQ ID NO: 2002
  Description of Artificial Sequence: Synthetic polypeptide

SEQ ID NO: 2852 - protein, 320 aa, Artificial Sequence; identical to SEQ ID NO: 2004
  Description of Artificial Sequence: Synthetic polypeptide

SEQ ID NO: 2853 - protein, 14 aa, Artificial Sequence
  Description of Artificial Sequence: Synthetic peptide
YDSLEIPPLSLPPP

SEQ ID NO: 2854 - protein, 43 aa, Artificial Sequence; identical to SEQ ID NO: 697
  Description of Artificial Sequence: Synthetic polypeptide

SEQ ID NO: 2855 - protein, 102 aa, Artificial Sequence; identical to SEQ ID NO: 698
  Description of Artificial Sequence: Synthetic polypeptide

SEQ ID NO: 2856 - protein, 41 aa, Artificial Sequence; identical to SEQ ID NO: 699
  Description of Artificial Sequence: Synthetic polypeptide

SEQ ID NO: 2857 - protein, 24 aa, Artificial Sequence
  Description of Artificial Sequence: Synthetic peptide
ARARRITWPSSRSSCASRCTWRAP

SEQ ID NO: 2858 - protein, 23 aa, Artificial Sequence
  Description of Artificial Sequence: Synthetic peptide
TATSSRSRARARAAPTRAPRPPS

SEQ ID NO: 2859 - protein, 24 aa, Artificial Sequence
  Description of Artificial Sequence: Synthetic peptide
PRVAPCPSPGTSCPLSSCTAPRPT

SEQ ID NO: 2860 - protein, 9 aa, Artificial Sequence
  Description of Artificial Sequence: Synthetic peptide
STPPTSPTT

SEQ ID NO: 2861 - protein, 12 aa, Artificial Sequence
  Description of Artificial Sequence: Synthetic peptide
SCPSPRASSGSA

SEQ ID NO: 2862 - protein, 7 aa, Artificial Sequence
  Description of Artificial Sequence: Synthetic peptide
TSRTAAW

SEQ ID NO: 2863 - protein, 14 aa, Artificial Sequence
  Description of Artificial Sequence: Synthetic peptide
PRTPPCRTASSSTR

SEQ ID NO: 2864 - protein, 12 aa, Artificial Sequence
  Description of Artificial Sequence: Synthetic peptide
SCAAPTSPPTAP

SEQ ID NO: 2865 - protein, 21 aa, Artificial Sequence
  Description of Artificial Sequence: Synthetic peptide
CRRRPWAGRPPPSGCTPRTAP

SEQ ID NO: 2866 - protein, 7 aa, Artificial Sequence
  Description of Artificial Sequence: Synthetic peptide
RARSSRG

SEQ ID NO: 2867 - protein, 64 aa, Artificial Sequence; identical to SEQ ID NO: 710
  Description of Artificial Sequence: Synthetic polypeptide

SEQ ID NO: 2868 - protein, 320 aa, Artificial Sequence; identical to SEQ ID NO: 2004
  Description of Artificial Sequence: Synthetic polypeptide

SEQ ID NO: 2869 - protein, 235 aa, Artificial Sequence; identical to SEQ ID NO: 1939
  Description of Artificial Sequence: Synthetic polypeptide

SEQ ID NO: 2870 - protein, 134 aa, Artificial Sequence; identical to SEQ ID NO: 2025
  Description of Artificial Sequence: Synthetic polypeptide

SEQ ID NO: 2871 - protein, 7 aa, Artificial Sequence
  Description of Artificial Sequence: Synthetic peptide
NLDNTTH

SEQ ID NO: 2872 - protein, 19 aa, Artificial Sequence
  Description of Artificial Sequence: Synthetic peptide
RSRPSPSPPPNVTGRSRLE

SEQ ID NO: 2873 - protein, 60 aa, Artificial Sequence; identical to SEQ ID NO: 2028
  Description of Artificial Sequence: Synthetic polypeptide

SEQ ID NO: 2874 - protein, 29 aa, Artificial Sequence
  Description of Artificial Sequence: Synthetic peptide
RQTTSVATLCRQRNPPPGDRCLCGQKPRV

SEQ ID NO: 2875 - protein, 58 aa, Artificial Sequence; identical to SEQ ID NO: 2030
  Description of Artificial Sequence: Synthetic polypeptide

SEQ ID NO: 2876 - protein, 18 aa, Artificial Sequence
  Description of Artificial Sequence: Synthetic peptide
SRLKKRLGPPNHGDVVFL

SEQ ID NO: 2877 - protein, 12 aa, Artificial Sequence
  Description of Artificial Sequence: Synthetic peptide
YGHNHDEQGRGG

SEQ ID NO: 2878 - protein, 171 aa, Artificial Sequence; identical to SEQ ID NO: 2033
  Description of Artificial Sequence: Synthetic polypeptide

SEQ ID NO: 2879 - protein, 56 aa, Artificial Sequence; identical to SEQ ID NO: 2034
  Description of Artificial Sequence: Synthetic polypeptide

SEQ ID NO: 2880 - protein, 134 aa, Artificial Sequence; identical to SEQ ID NO: 2025
  Description of Artificial Sequence: Synthetic polypeptide

SEQ ID NO: 2881 - protein, 235 aa, Artificial Sequence; identical to SEQ ID NO: 1939
  Description of Artificial Sequence: Synthetic polypeptide

SEQ ID NO: 2882 - protein, 30 aa, Homo sapiens; identical to SEQ ID NO: 1919

SEQ ID NO: 2883 - protein, 26 aa, Artificial Sequence
  Description of Artificial Sequence: Synthetic peptide
SGGGSGGGGSGGGGSGGGGSGGGSLQ

SEQ ID NO: 2884 - protein, 5 aa, Artificial Sequence
  Description of Artificial Sequence: Synthetic peptide
SGGGS

SEQ ID NO: 2885 - protein, 34 aa, Artificial Sequence; identical to SEQ ID NO: 1924
  Description of Artificial Sequence: Synthetic polypeptide

SEQ ID NO: 2886 - protein, 20 aa, Artificial Sequence
  Description of Artificial Sequence: Synthetic peptide
SGGGSGGGGSGGGGSGGGGS

SEQ ID NO: 2887 - protein, 69 aa, Homo sapiens; identical to SEQ ID NO: 607

SEQ ID NO: 2888 - protein, 235 aa, Artificial Sequence; identical to SEQ ID NO: 1939
  Description of Artificial Sequence: Synthetic polypeptide

SEQ ID NO: 2889 - protein, 158 aa, Artificial Sequence; identical to SEQ ID NO: 1175
  Description of Artificial Sequence: Synthetic polypeptide

SEQ ID NO: 2890 - protein, 107 aa, Artificial Sequence; identical to SEQ ID NO: 1177
  Description of Artificial Sequence: Synthetic polypeptide

SEQ ID NO: 2891 - protein, 186 aa, Artificial Sequence; identical to SEQ ID NO: 41
  Description of Artificial Sequence: Synthetic polypeptide

SEQ ID NO: 2892 - protein, 186 aa, Artificial Sequence; identical to SEQ ID NO: 56
  Description of Artificial Sequence: Synthetic polypeptide

SEQ ID NO: 2893 - protein, 186 aa, Artificial Sequence; identical to SEQ ID NO: 1251
  Description of Artificial Sequence: Synthetic polypeptide

SEQ ID NO: 2894 - protein, 186 aa, Artificial Sequence; identical to SEQ ID NO: 1250
  Description of Artificial Sequence: Synthetic polypeptide

SEQ ID NO: 2895 - protein, 186 aa, Artificial Sequence; identical to SEQ ID NO: 1254
  Description of Artificial Sequence: Synthetic polypeptide

SEQ ID NO: 2896 - protein, 186 aa, Artificial Sequence; identical to SEQ ID NO: 1256
  Description of Artificial Sequence: Synthetic polypeptide

SEQ ID NO: 2897 - protein, 186 aa, Artificial Sequence; identical to SEQ ID NO: 33
  Description of Artificial Sequence: Synthetic polypeptide

SEQ ID NO: 2898 - protein, 186 aa, Artificial Sequence; identical to SEQ ID NO: 1255
  Description of Artificial Sequence: Synthetic polypeptide

SEQ ID NO: 2899 - protein, 555 aa, Artificial Sequence; identical to SEQ ID NO: 1949
  Description of Artificial Sequence: Synthetic polypeptide

SEQ ID NO: 2900 - protein, 504 aa, Artificial Sequence; identical to SEQ ID NO: 1951
  Description of Artificial Sequence: Synthetic polypeptide

SEQ ID NO: 2901 - protein, 395 aa, Artificial Sequence [sequence omitted]

SEQ ID NO: 2902 - protein, 555 aa, Artificial Sequence; identical to SEQ ID NO: 1955
  Description of Artificial Sequence: Synthetic polypeptide

SEQ ID NO: 2903 - protein, 583 aa, Artificial Sequence; identical to SEQ ID NO: 1957
  Description of Artificial Sequence: Synthetic polypeptide

SEQ ID NO: 2904 - protein, 583 aa, Artificial Sequence; identical to SEQ ID NO: 1959
  Description of Artificial Sequence: Synthetic polypeptide

SEQ ID NO: 2905 - protein, 583 aa, Artificial Sequence; identical to SEQ ID NO: 1961
  Description of Artificial Sequence: Synthetic polypeptide

SEQ ID NO: 2906 - protein, 583 aa, Artificial Sequence; identical to SEQ ID NO: 1963
  Description of Artificial Sequence: Synthetic polypeptide

SEQ ID NO: 2907 - protein, 583 aa, Artificial Sequence; identical to SEQ ID NO: 1965
  Description of Artificial Sequence: Synthetic polypeptide

SEQ ID NO: 2908 - protein, 404 aa, Artificial Sequence; identical to SEQ ID NO: 1967
  Description of Artificial Sequence: Synthetic polypeptide

SEQ ID NO: 2909 - protein, 403 aa, Artificial Sequence; identical to SEQ ID NO: 1969
  Description of Artificial Sequence: Synthetic polypeptide

SEQ ID NO: 2910 - protein, 403 aa, Artificial Sequence; identical to SEQ ID NO: 1971
  Description of Artificial Sequence: Synthetic polypeptide

SEQ ID NO: 2911 - protein, 371 aa, Artificial Sequence; identical to SEQ ID NO: 1973
  Description of Artificial Sequence: Synthetic polypeptide

SEQ ID NO: 2912 - protein, 407 aa, Artificial Sequence; identical to SEQ ID NO: 1975
  Description of Artificial Sequence: Synthetic polypeptide

SEQ ID NO: 2913 - protein, 397 aa, Artificial Sequence; identical to SEQ ID NO: 1977
  Description of Artificial Sequence: Synthetic polypeptide

SEQ ID NO: 2914 - protein, 555 aa, Artificial Sequence; identical to SEQ ID NO: 1955
  Description of Artificial Sequence: Synthetic polypeptide

SEQ ID NO: 2915 - protein, 407 aa, Artificial Sequence; identical to SEQ ID NO: 1975
  Description of Artificial Sequence: Synthetic polypeptide

SEQ ID NO: 2916 - protein, 371 aa, Artificial Sequence; identical to SEQ ID NO: 2140
  Description of Artificial Sequence: Synthetic polypeptide

SEQ ID NO: 2917 - protein, 573 aa, Artificial Sequence; identical to SEQ ID NO: 1984
  Description of Artificial Sequence: Synthetic polypeptide

SEQ ID NO: 2918 - protein, 414 aa, Artificial Sequence; identical to SEQ ID NO: 1986
  Description of Artificial Sequence: Synthetic polypeptide

SEQ ID NO: 2919 - protein, 601 aa, Artificial Sequence; identical to SEQ ID NO: 1988
  Description of Artificial Sequence: Synthetic polypeptide

SEQ ID NO: 2920 - protein, 601 aa, Artificial Sequence; identical to SEQ ID NO: 1990
  Description of Artificial Sequence: Synthetic polypeptide

SEQ ID NO: 2921 - protein, 601 aa, Artificial Sequence; identical to SEQ ID NO: 1992
  Description of Artificial Sequence: Synthetic polypeptide

SEQ ID NO: 2922 - protein, 601 aa, Artificial Sequence; identical to SEQ ID NO: 1994
  Description of Artificial Sequence: Synthetic polypeptide

SEQ ID NO: 2923 - protein, 601 aa, Artificial Sequence; identical to SEQ ID NO: 1996
  Description of Artificial Sequence: Synthetic polypeptide

SEQ ID NO: 2924 - protein, 601 aa, Artificial Sequence; identical to SEQ ID NO: 1998
  Description of Artificial Sequence: Synthetic polypeptide

SEQ ID NO: 2925 - protein, 681 aa, Artificial Sequence; identical to SEQ ID NO: 2000
  Description of Artificial Sequence: Synthetic polypeptide

SEQ ID NO: 2926 - protein, 652 aa, Artificial Sequence; identical to SEQ ID NO: 2002
  Description of Artificial Sequence: Synthetic polypeptide

SEQ ID NO: 2927 - protein, 320 aa, Artificial Sequence; identical to SEQ ID NO: 2004
  Description of Artificial Sequence: Synthetic polypeptide

SEQ ID NO: 2928 - protein, 14 aa, Artificial Sequence
  Description of Artificial Sequence: Synthetic peptide
YDSLEIPPLSLPPP

SEQ ID NO: 2929 - protein, 43 aa, Artificial Sequence; identical to SEQ ID NO: 697
  Description of Artificial Sequence: Synthetic polypeptide

SEQ ID NO: 2930 - protein, 102 aa, Artificial Sequence; identical to SEQ ID NO: 698
  Description of Artificial Sequence: Synthetic polypeptide

SEQ ID NO: 2931 - protein, 41 aa, Artificial Sequence; identical to SEQ ID NO: 699
  Description of Artificial Sequence: Synthetic polypeptide

SEQ ID NO: 2932 - protein, 24 aa, Artificial Sequence
  Description of Artificial Sequence: Synthetic peptide
ARARRITWPSSRSSCASRCTWRAP

SEQ ID NO: 2933 - protein, 23 aa, Artificial Sequence
  Description of Artificial Sequence: Synthetic peptide
TATSSRSRARARAAPTRAPRPPS

SEQ ID NO: 2934 - protein, 24 aa, Artificial Sequence
  Description of Artificial Sequence: Synthetic peptide
PRVAPCPSPGTSCPLSSCTAPRPT

SEQ ID NO: 2935 - protein, 9 aa, Artificial Sequence
  Description of Artificial Sequence: Synthetic peptide
STPPTSPTT

SEQ ID NO: 2936 - protein, 12 aa, Artificial Sequence
  Description of Artificial Sequence: Synthetic peptide
SCPSPRASSGSA

SEQ ID NO: 2937 - protein, 7 aa, Artificial Sequence
  Description of Artificial Sequence: Synthetic peptide
TSRTAAW

SEQ ID NO: 2938 - protein, 14 aa, Artificial Sequence
  Description of Artificial Sequence: Synthetic peptide
PRTPPCRTASSSTR

SEQ ID NO: 2939 - protein, 12 aa, Artificial Sequence
  Description of Artificial Sequence: Synthetic peptide
SCAAPTSPPTAP

SEQ ID NO: 2940 - protein, 21 aa, Artificial Sequence
  Description of Artificial Sequence: Synthetic peptide
CRRRPWAGRPPPSGCTPRTAP

SEQ ID NO: 2941 - protein, 7 aa, Artificial Sequence
  Description of Artificial Sequence: Synthetic peptide
RARSSRG

SEQ ID NO: 2942 - protein, 64 aa, Artificial Sequence; identical to SEQ ID NO: 710
  Description of Artificial Sequence: Synthetic polypeptide

SEQ ID NO: 2943 - protein, 320 aa, Artificial Sequence; identical to SEQ ID NO: 2004
  Description of Artificial Sequence: Synthetic polypeptide

SEQ ID NO: 2944 - protein, 235 aa, Artificial Sequence; identical to SEQ ID NO: 1939
  Description of Artificial Sequence: Synthetic polypeptide

SEQ ID NO: 2945 - protein, 134 aa, Artificial Sequence; identical to SEQ ID NO: 2025
  Description of Artificial Sequence: Synthetic polypeptide

SEQ ID NO: 2946 - protein, 7 aa, Artificial Sequence
  Description of Artificial Sequence: Synthetic peptide
NLDNTTH

SEQ ID NO: 2947 - protein, 19 aa, Artificial Sequence
  Description of Artificial Sequence: Synthetic peptide
RSRPSPSPPPNVTGRSRLE

SEQ ID NO: 2948 - protein, 60 aa, Artificial Sequence; identical to SEQ ID NO: 2028
  Description of Artificial Sequence: Synthetic polypeptide

SEQ ID NO: 2949 - protein, 29 aa, Artificial Sequence
  Description of Artificial Sequence: Synthetic peptide
RQTTSVATLCRQRNPPPGDRCLCGQKPRV

SEQ ID NO: 2950 - protein, 58 aa, Artificial Sequence; identical to SEQ ID NO: 2030
  Description of Artificial Sequence: Synthetic polypeptide

SEQ ID NO: 2951 - protein, 18 aa, Artificial Sequence
  Description of Artificial Sequence: Synthetic peptide
SRLKKRLGPPNHGDVVFL

SEQ ID NO: 2952 - protein, 12 aa, Artificial Sequence
  Description of Artificial Sequence: Synthetic peptide
YGHNHDEQGRGG

SEQ ID NO: 2953 - protein, 171 aa, Artificial Sequence; identical to SEQ ID NO: 2033
  Description of Artificial Sequence: Synthetic polypeptide

SEQ ID NO: 2954 - protein, 56 aa, Artificial Sequence; identical to SEQ ID NO: 2034
  Description of Artificial Sequence: Synthetic polypeptide

SEQ ID NO: 2955 - protein, 134 aa, Artificial Sequence; identical to SEQ ID NO: 2025
  Description of Artificial Sequence: Synthetic polypeptide

SEQ ID NO: 2956 - protein, 20 aa, Homo sapiens
MYRMQLLSCIALSLALVTNS

SEQ ID NO: 2957 - protein, 18 aa, Homo sapiens
MDWTWILFLVAAATRVHS

SEQ ID NO: 2958 - protein, 114 aa, Homo sapiens; identical to SEQ ID NO: 718

SEQ ID NO: 2959 - protein, 237 aa, Homo sapiens; identical to SEQ ID NO: 724

SEQ ID NO: 2960 - protein, 26 aa, Artificial Sequence
  Description of Artificial Sequence: Synthetic peptide
SGGGSGGGGSGGGGSGGGGSGGGSLQ

SEQ ID NO: 2961 - protein, 395 aa, Artificial Sequence [sequence omitted]

SEQ ID NO: 2962 - protein, 15 aa, Artificial Sequence
  Description of Artificial Sequence: Synthetic peptide
GGGGSGGGGSGGGGS

SEQ ID NO: 2963 - protein, 12 aa, Artificial Sequence
  Description of Artificial Sequence: Synthetic peptide
ESRRVRRNKRSK

SEQ ID NO: 2964 - protein, 306 aa, Homo sapiens; identical to SEQ ID NO: 734

SEQ ID NO: 2965 - protein, 197 aa, Homo sapiens; identical to SEQ ID NO: 735

SEQ ID NO: 2966 - protein, 193 aa, Homo sapiens; identical to SEQ ID NO: 2256

SEQ ID NO: 2967 - protein, 540 aa, Artificial Sequence; identical to SEQ ID NO: 1831
  Description of Artificial Sequence: Synthetic polypeptide

SEQ ID NO: 2968 - protein, 738 aa, Artificial Sequence; identical to SEQ ID NO: 1835
  Description of Artificial Sequence: Synthetic polypeptide

SEQ ID NO: 2969 - protein, 416 aa, Homo sapiens; identical to SEQ ID NO: 2260

SEQ ID NO: 2970 - protein, 415 aa, Homo sapiens; identical to SEQ ID NO: 744

SEQ ID NO: 2971 - protein, 5 aa, Artificial Sequence
  Description of Artificial Sequence: Synthetic peptide
SGGGS

SEQ ID NO: 2972 - protein, 607 aa, Artificial Sequence; identical to SEQ ID NO: 1151
  Description of Artificial Sequence: Synthetic polypeptide

SEQ ID NO: 2973 - protein, 607 aa, Artificial Sequence; identical to SEQ ID NO: 1152
  Description of Artificial Sequence: Synthetic polypeptide

SEQ ID NO: 2974 - protein, 607 aa, Artificial Sequence; identical to SEQ ID NO: 1153
  Description of Artificial Sequence: Synthetic polypeptide

SEQ ID NO: 2975 - protein, 285 aa, Homo sapiens; identical to SEQ ID NO: 2271

SEQ ID NO: 2976 - protein, 13 aa, Artificial Sequence
  Description of Artificial Sequence: Synthetic peptide
VDYPYDVPDYALD

SEQ ID NO: 2977 - protein, 5 aa, Artificial Sequence
  Description of Artificial Sequence: Synthetic peptide
SGGGS

SEQ ID NO: 2978 - protein, 107 aa, Artificial Sequence; identical to SEQ ID NO: 2282
  Description of Artificial Sequence: Synthetic polypeptide

SEQ ID NO: 2979 - protein, 159 aa, Artificial Sequence; identical to SEQ ID NO: 1173
  Description of Artificial Sequence: Synthetic polypeptide

SEQ ID NO: 2980 - protein, 158 aa, Artificial Sequence; identical to SEQ ID NO: 2286
  Description of Artificial Sequence: Synthetic polypeptide

SEQ ID NO: 2981 - protein, 187 aa, Artificial Sequence; identical to SEQ ID NO: 11
  Description of Artificial Sequence: Synthetic polypeptide

SEQ ID NO: 2982 - protein, 187 aa, Artificial Sequence; identical to SEQ ID NO: 27
  Description of Artificial Sequence: Synthetic polypeptide

SEQ ID NO: 2983 - protein, 187 aa, Artificial Sequence; identical to SEQ ID NO: 20
  Description of Artificial Sequence: Synthetic polypeptide

SEQ ID NO: 2984 - protein, 9 aa, Homo sapiens
SARNRQKRS

SEQ ID NO: 2985 - protein, 8 aa, Homo sapiens
ARNRQKRS

SEQ ID NO: 2986 - protein, 14 aa, Artificial Sequence
  Description of Artificial Sequence: Synthetic peptide
SGESRRVRRNKRSK

SEQ ID NO: 2987 - protein, 19 aa, Artificial Sequence
  Description of Artificial Sequence: Synthetic peptide
ATNFSLLKQAGDVEENPGP

SEQ ID NO: 2988 - protein, 4 aa, Artificial Sequence
  Description of Artificial Sequence: Synthetic peptide
NPGP

SEQ ID NO: 2989 - protein, 9 aa, Homo sapiens
SARNRQKRS

SEQ ID NO: 2990 - protein, 8 aa, Homo sapiens
ARNRQKRS

SEQ ID NO: 2991 - protein, 14 aa, Artificial Sequence
  Description of Artificial Sequence: Synthetic peptide
SGESRRVRRNKRSK

SEQ ID NO: 2992 - protein, 19 aa, Artificial Sequence
  Description of Artificial Sequence: Synthetic peptide
ATNFSLLKQAGDVEENPGP

SEQ ID NO: 2993 - protein, 20 aa, Artificial Sequence
  Description of Artificial Sequence: Synthetic peptide
GATNFSLLKQAGDVEENPGP

SEQ ID NO: 2994 - protein, 4 aa, Artificial Sequence
  Description of Artificial Sequence: Synthetic peptide
NPGP

SEQ ID NO: 2995 - protein, 9 aa, Homo sapiens
SARNRQKRS

SEQ ID NO: 2996 - protein, 8 aa, Homo sapiens
ARNRQKRS

SEQ ID NO: 2997 - protein, 12 aa, Artificial Sequence
  Description of Artificial Sequence: Synthetic peptide
ESRRVRRNKRSK

SEQ ID NO: 2998 - protein, 9 aa, Artificial Sequence
  Description of Artificial Sequence: Synthetic peptide
YPYDVPDYA

SEQ ID NO: 2999 - protein, 4 aa, Artificial Sequence
  Description of Artificial Sequence: Synthetic peptide
GGSG

SEQ ID NO: 3000 - protein, 5 aa, Artificial Sequence
  Description of Artificial Sequence: Synthetic peptide
GGGGG

SEQ ID NO: 3001 - protein, 5 aa, Artificial Sequence
  Description of Artificial Sequence: Synthetic peptide
GGGGG

SEQ ID NO: 3002 - protein, 5 aa, Artificial Sequence
  Description of Artificial Sequence: Synthetic peptide
GGGGS

SEQ ID NO: 3003 - protein, 10 aa, Artificial Sequence
  Description of Artificial Sequence: Synthetic peptide
GGGGSGGGGS

SEQ ID NO: 3004 - protein, 15 aa, Artificial Sequence
  Description of Artificial Sequence: Synthetic peptide
GGGGSGGGGSGGGGS

SEQ ID NO: 3005 - protein, 20 aa, Artificial Sequence
  Description of Artificial Sequence: Synthetic peptide
GGGGSGGGGSGGGGSGGGGS

SEQ ID NO: 3006 - protein, 25 aa, Artificial Sequence
  Description of Artificial Sequence: Synthetic peptide
GGGGSGGGGSGGGGSGGGGSGGGGS

SEQ ID NO: 3007 - protein, 30 aa, Artificial Sequence; identical to SEQ ID NO: 2399
  Description of Artificial Sequence: Synthetic polypeptide

SEQ ID NO: 3008 - protein, 5 aa, Artificial Sequence
  Description of Artificial Sequence: Synthetic peptide
SSSSG

SEQ ID NO: 3009 - protein, 10 aa, Artificial Sequence
  Description of Artificial Sequence: Synthetic peptide
SSSSGSSSSG

SEQ ID NO: 3010 - protein, 15 aa, Artificial Sequence
  Description of Artificial Sequence: Synthetic peptide
SSSSGSSSSGSSSSG

SEQ ID NO: 3011 - protein, 20 aa, Artificial Sequence
  Description of Artificial Sequence: Synthetic peptide
SSSSGSSSSGSSSSGSSSSG

SEQ ID NO: 3012 - protein, 25 aa, Artificial Sequence
  Description of Artificial Sequence: Synthetic peptide
SSSSGSSSSGSSSSGSSSSGSSSSG

SEQ ID NO: 3013 - protein, 30 aa, Artificial Sequence; identical to SEQ ID NO: 2405
  Description of Artificial Sequence: Synthetic polypeptide

SEQ ID NO: 3014 - protein, 6 aa, Artificial Sequence
  Description of Artificial Sequence: Synthetic peptide
EFSTEF

SEQ ID NO: 3015 - protein, 5 aa, Artificial Sequence
  Description of Artificial Sequence: Synthetic peptide
SGGGS

SEQ ID NO: 3016 - protein, 12 aa, Artificial Sequence
  Description of Artificial Sequence: Synthetic peptide
GKSSGSGSESKS

SEQ ID NO: 3017 - protein, 15 aa, Artificial Sequence
  Description of Artificial Sequence: Synthetic peptide
GGSTSGSGKSSEGKG

SEQ ID NO: 3018 - protein, 19 aa, Artificial Sequence
  Description of Artificial Sequence: Synthetic peptide
GSTSGSGKSSSEGSGSTKG

SEQ ID NO: 3019 - protein, 18 aa, Artificial Sequence
  Description of Artificial Sequence: Synthetic peptide
GSTSGSGKPGSGEGSTKG

SEQ ID NO: 3020 - protein, 13 aa, Artificial Sequence
  Description of Artificial Sequence: Synthetic peptide
VDYPYDVPDYALD

SEQ ID NO: 3021 - protein, 14 aa, Artificial Sequence
  Description of Artificial Sequence: Synthetic peptide
EGKSSGSGSESKEF

SEQ ID NO: 3022 - protein, 35 aa, Artificial Sequence; identical to SEQ ID NO: 2418
  Description of Artificial Sequence: Synthetic polypeptide

SEQ ID NO: 3023 - protein, 8 aa, Artificial Sequence
  Description of Artificial Sequence: Synthetic peptide
DYKDDDDK

SEQ ID NO: 3024 - protein, 34 aa, Artificial Sequence; identical to SEQ ID NO: 1924
  Description of Artificial Sequence: Synthetic polypeptide

SEQ ID NO: 3025 - protein, 34 aa, Artificial Sequence; identical to SEQ ID NO: 2424
  Description of Artificial Sequence: Synthetic polypeptide

SEQ ID NO: 3026 - protein, 22 aa, Artificial Sequence
  Description of Artificial Sequence: Synthetic peptide
GSGATNFSLLKQAGDVEENPGP

SEQ ID NO: 3027 - protein, 22 aa, Artificial Sequence
  Description of Artificial Sequence: Synthetic peptide
SGGGGSGGGGSGGGGSGGGSLQ

SEQ ID NO: 3028 - protein, 14 aa, Artificial Sequence
  Description of Artificial Sequence: Synthetic peptide
EGKSSGSGSESKEF

SEQ ID NO: 3029 - protein, 35 aa, Artificial Sequence; identical to SEQ ID NO: 2418
  Description of Artificial Sequence: Synthetic polypeptide

SEQ ID NO: 3030 - protein, 8 aa, Artificial Sequence
  Description of Artificial Sequence: Synthetic peptide
DYKDDDDK

SEQ ID NO: 3031 - protein, 34 aa, Artificial Sequence; identical to SEQ ID NO: 1924
  Description of Artificial Sequence: Synthetic polypeptide

SEQ ID NO: 3032 - protein, 34 aa, Artificial Sequence; identical to SEQ ID NO: 2424
  Description of Artificial Sequence: Synthetic polypeptide

SEQ ID NO: 3033 - protein, 34 aa, Artificial Sequence; identical to SEQ ID NO: 2424
  Description of Artificial Sequence: Synthetic polypeptide

SEQ ID NO: 3034 - protein, 22 aa, Artificial Sequence
  Description of Artificial Sequence: Synthetic peptide
GSGATNFSLLKQAGDVEENPGP

SEQ ID NO: 3035 - protein, 4 aa, Artificial Sequence
  Description of Artificial Sequence: Synthetic peptide
GGSG

SEQ ID NO: 3036 - protein, 5 aa, Artificial Sequence
  Description of Artificial Sequence: Synthetic peptide
GGSGG

SEQ ID NO: 3037 - protein, 6 aa, Artificial Sequence
  Description of Artificial Sequence: Synthetic peptide
GGSGGG

SEQ ID NO: 3038 - protein, 9 aa, Artificial Sequence
  Description of Artificial Sequence: Synthetic peptide
GGSGGGSGG

SEQ ID NO: 3039 - protein, 5 aa, Artificial Sequence
  Description of Artificial Sequence: Synthetic peptide
GGGGG

SEQ ID NO: 3040 - protein, 5 aa, Artificial Sequence
  Description of Artificial Sequence: Synthetic peptide
GGGGS

SEQ ID NO: 3041 - protein, 10 aa, Artificial Sequence
  Description of Artificial Sequence: Synthetic peptide
GGGGSGGGGS

SEQ ID NO: 3042 - protein, 15 aa, Artificial Sequence
  Description of Artificial Sequence: Synthetic peptide
GGGGSGGGGSGGGGS

SEQ ID NO: 3043 - protein, 26 aa, Artificial Sequence
  Description of Artificial Sequence: Synthetic peptide
SGGGSGGGGSGGGGSGGGGSGGGSLQ

SEQ ID NO: 3044 - protein, 20 aa, Artificial Sequence
  Description of Artificial Sequence: Synthetic peptide
GGGGSGGGGSGGGGSGGGGS

SEQ ID NO: 3045 - protein, 25 aa, Artificial Sequence
  Description of Artificial Sequence: Synthetic peptide
GGGGSGGGGSGGGGSGGGGSGGGGS

SEQ ID NO: 3046 - protein, 30 aa, Artificial Sequence; identical to SEQ ID NO: 2399
  Description of Artificial Sequence: Synthetic polypeptide

SEQ ID NO: 3047 - protein, 5 aa, Artificial Sequence
  Description of Artificial Sequence: Synthetic peptide
SSSSG

SEQ ID NO: 3048 - protein, 10 aa, Artificial Sequence
  Description of Artificial Sequence: Synthetic peptide
SSSSGSSSSG

SEQ ID NO: 3049 - protein, 15 aa, Artificial Sequence
  Description of Artificial Sequence: Synthetic peptide
SSSSGSSSSGSSSSG

SEQ ID NO: 3050 - protein, 20 aa, Artificial Sequence
  Description of Artificial Sequence: Synthetic peptide
SSSSGSSSSGSSSSGSSSSG

SEQ ID NO: 3051 - protein, 25 aa, Artificial Sequence
  Description of Artificial Sequence: Synthetic peptide
SSSSGSSSSGSSSSGSSSSGSSSSG

SEQ ID NO: 3052 - protein, 30 aa, Artificial Sequence; identical to SEQ ID NO: 2405
  Description of Artificial Sequence: Synthetic polypeptide

SEQ ID NO: 3053 - protein, 12 aa, Artificial Sequence
  Description of Artificial Sequence: Synthetic peptide
GKSSGSGSESKS

SEQ ID NO: 3054 - protein, 15 aa, Artificial Sequence
  Description of Artificial Sequence: Synthetic peptide
GGSTSGSGKSSEGKG

SEQ ID NO: 3055 - protein, 19 aa, Artificial Sequence
  Description of Artificial Sequence: Synthetic peptide
GSTSGSGKSSSEGSGSTKG

SEQ ID NO: 3056 - protein, 18 aa, Artificial Sequence
  Description of Artificial Sequence: Synthetic peptide
GSTSGSGKPGSGEGSTKG

SEQ ID NO: 3057 - protein, 20 aa, Artificial Sequence
  Description of Artificial Sequence: Synthetic peptide
SGGGSGGGGSGGGGSGGGGS

SEQ ID NO: 3058 - protein, 4 aa, Artificial Sequence
  Description of Artificial Sequence: Synthetic peptide
GGGG

SEQ ID NO: 3059 - protein, 8 aa, Artificial Sequence
  Description of Artificial Sequence: Synthetic peptide
GGGGGGGG

SEQ ID NO: 3060 - protein, 8 aa, Artificial Sequence
  Description of Artificial Sequence: Synthetic peptide
  MOD_RES (4)..(4): Any amino acid
DVEXNPGP

SEQ ID NO: 3061 - protein, 557 aa, Homo sapiens; identical to SEQ ID NO: 2690

SEQ ID NO: 3062 - protein, 556 aa, Homo sapiens [sequence omitted]

SEQ ID NO: 3063 - protein, 557 aa, Macaca mulatta; identical to SEQ ID NO: 2692

SEQ ID NO: 3064 - protein, 557 aa, Artificial Sequence; identical to SEQ ID NO: 2693
  Description of Artificial Sequence: Synthetic polypeptide

SEQ ID NO: 3065 - protein, 557 aa, Artificial Sequence; identical to SEQ ID NO: 2694
  Description of Artificial Sequence: Synthetic polypeptide

SEQ ID NO: 3066 - protein, 467 aa, Artificial Sequence; identical to SEQ ID NO: 2695
  Description of Artificial Sequence: Synthetic polypeptide

SEQ ID NO: 3067 - protein, 278 aa, Artificial Sequence; identical to SEQ ID NO: 2696
  Description of Artificial Sequence: Synthetic polypeptide

SEQ ID NO: 3068 - protein, 189 aa, Artificial Sequence; identical to SEQ ID NO: 2697
  Description of Artificial Sequence: Synthetic polypeptide

SEQ ID NO: 3069 - protein, 311 aa, Renilla reniformis; identical to SEQ ID NO: 2698

SEQ ID NO: 3070 - protein, 550 aa, Photinus pyralis; identical to SEQ ID NO: 2700

SEQ ID NO: 3071 - protein, 311 aa, Renilla reniformis; identical to SEQ ID NO: 2698

SEQ ID NO: 3072 - protein, 660 aa, Artificial Sequence; identical to SEQ ID NO: 2709
  Description of Artificial Sequence: Synthetic polypeptide

SEQ ID NO: 3073 - protein, 420 aa, Artificial Sequence; identical to SEQ ID NO: 2710
  Description of Artificial Sequence: Synthetic polypeptide

SEQ ID NO: 3074 - protein, 471 aa, Artificial Sequence; identical to SEQ ID NO: 2711
  Description of Artificial Sequence: Synthetic polypeptide

SEQ ID NO: 3075 - protein, 420 aa, Artificial Sequence; identical to SEQ ID NO: 2712
  Description of Artificial Sequence: Synthetic polypeptide

SEQ ID NO: 3076 - protein, 471 aa, Artificial Sequence; identical to SEQ ID NO: 2713
  Description of Artificial Sequence: Synthetic polypeptide

SEQ ID NO: 3077 - DNA, 1416 bp, Artificial Sequence; identical to SEQ ID NO: 2727
  Description of Artificial Sequence: Synthetic Construct

SEQ ID NO: 3078 - protein, 5 aa, Artificial Sequence
  Description of Artificial Sequence: Synthetic peptide
GGSGG

SEQ ID NO: 3079 - protein, 12 aa, Artificial Sequence
  Description of Artificial Sequence: Synthetic peptide
ESRRVRRNKRSK

SEQ ID NO: 3080 - protein, 9 aa, Artificial Sequence
  Description of Artificial Sequence: Synthetic peptide
YPYDVPDYA

SEQ ID NO: 3081 - protein, 20 aa, Artificial Sequence
  Description of Artificial Sequence: Synthetic peptide
GATNFSLLKQAGDVEENPGP

SEQ ID NO: 3082 - protein, 13 aa, Artificial Sequence
  Description of Artificial Sequence: Synthetic peptide
QLIGMLQGLMRDL

SEQ ID NO: 3083 - protein, 12 aa, Artificial Sequence
  Description of Artificial Sequence: Synthetic peptide
ESRRVRRNKRSK

SEQ ID NO: 3084 - protein, 8 aa, Artificial Sequence
  Description of Artificial Sequence: Synthetic peptide
  MOD_RES (4)..(4): Any amino acid
DIEXNPGP

SEQ ID NO: 3085 - protein, 33 aa, Artificial Sequence
  Description of Artificial Sequence: Synthetic polypeptide
SGGGSGGGGSGGGGSGGGGSGGGGSGGGGSGGG

SEQ ID NO: 3086 - protein, 6 aa, Artificial Sequence
  Description of Artificial Sequence: Synthetic peptide
EFSTEF

SEQ ID NO: 3087 - protein, 34 aa, Artificial Sequence; identical to SEQ ID NO: 1924
  Description of Artificial Sequence: Synthetic polypeptide

SEQ ID NO: 3088 - protein, 20 aa, Artificial Sequence
  Description of Artificial Sequence: Synthetic peptide
SGGGSGGGGSGGGGSGGGGS

SEQ ID NO: 3089 - protein, 5 aa, Artificial Sequence
  Description of Artificial Sequence: Synthetic peptide
SGGGS

SEQ ID NO: 3090 - protein, 13 aa, Artificial Sequence
  Description of Artificial Sequence: Synthetic peptide
QLIGMLQGLMRDL

SEQ ID NO: 3091 - protein, 6 aa, Artificial Sequence
  Description of Artificial Sequence: Synthetic 6xHis tag
HHHHHH

SEQ ID NO: 3092 - protein, 4 aa, Artificial Sequence
  Description of Artificial Sequence: Synthetic peptide
ASFE

SEQ ID NO: 3093 - protein, 67 aa, Homo sapiens
VYKEAMNHPGHLKLFVTRIMQDFESDTFFPEIDLEKYKLLPEYPGVLSDVQEEKGIKYKFEVYEKND

SEQ ID NO: 3094 - protein, 67 aa, Artificial Sequence
  Description of Artificial Sequence: Synthetic polypeptide
VYKEAMNHPGHLKLFVTIIMQDFESDTFFPEIDLEKYKLLPEYPGVLSDVQEEKGIKYKFEVYEEND

SEQ ID NO: 3095 - DNA, 1335 bp, Artificial Sequence; identical to SEQ ID NO: 1798
  Description of Artificial Sequence: Synthetic Promoter sequence

SEQ ID NO: 3096 - DNA, 399 bp, Artificial Sequence; identical to SEQ ID NO: 1797
  Description of Artificial Sequence: Synthetic Promoter sequence

SEQ ID NO: 3097 - DNA, 1339 bp, Artificial Sequence; identical to SEQ ID NO: 1796
  Description of Artificial Sequence: Synthetic Promoter sequence

SEQ ID NO: 3098 - DNA, 603 bp, Artificial Sequence; identical to SEQ ID NO: 1795
  Description of Artificial Sequence: Synthetic Promoter sequence

SEQ ID NO: 3099 - DNA, 603 bp, Artificial Sequence; identical to SEQ ID NO: 1795
  Description of Artificial Sequence: Synthetic promoter

SEQ ID NO: 3100 - DNA, 399 bp, Artificial Sequence; identical to SEQ ID NO: 1797
  Description of Artificial Sequence: Synthetic promoter

SEQ ID NO: 3101 - DNA, 1339 bp, Artificial Sequence; identical to SEQ ID NO: 1796
  Description of Artificial Sequence: Synthetic promoter

SEQ ID NO: 3102 - DNA, 1335 bp, Artificial Sequence; identical to SEQ ID NO: 1798
  Description of Artificial Sequence: Synthetic promoter

SEQ ID NO: 3103 - protein, 158 aa, Artificial Sequence; identical to SEQ ID NO: 1174
  Description of Artificial Sequence: Synthetic destabilizing domain (DD)

SEQ ID NO: 3104 - protein, 239 aa, Artificial Sequence; identical to SEQ ID NO: 1181
  Description of Artificial Sequence: Synthetic polypeptide

SEQ ID NO: 3105 - DNA, 561 bp, Artificial Sequence; identical to SEQ ID NO: 90
  Description of Artificial Sequence: Synthetic Destabilizing Domain (DD)

SEQ ID NO: 3106 - protein, 187 aa, Homo sapiens; identical to SEQ ID NO: 1

SEQ ID NO: 3107 - protein, 187 aa, Artificial Sequence; identical to SEQ ID NO: 2
  Description of Artificial Sequence: Synthetic destabilizing domain (DD)

SEQ ID NO: 3108 - protein, 187 aa, Artificial Sequence; identical to SEQ ID NO: 3
  Description of Artificial Sequence: Synthetic destabilizing domain (DD)

SEQ ID NO: 3109 - protein, 187 aa, Artificial Sequence; identical to SEQ ID NO: 4
  Description of Artificial Sequence: Synthetic destabilizing domain (DD)

SEQ ID NO: 3110 - protein, 187 aa, Artificial Sequence; identical to SEQ ID NO: 5
  Description of Artificial Sequence: Synthetic destabilizing domain (DD)

SEQ ID NO: 3111 - protein, 187 aa, Artificial Sequence; identical to SEQ ID NO: 6
  Description of Artificial Sequence: Synthetic destabilizing domain (DD)

SEQ ID NO: 3112 - protein, 187 aa, Artificial Sequence; identical to SEQ ID NO: 7
  Description of Artificial Sequence: Synthetic destabilizing domain (DD)

SEQ ID NO: 3113 - protein, 187 aa, Artificial Sequence; identical to SEQ ID NO: 8
  Description of Artificial Sequence: Synthetic destabilizing domain (DD)

SEQ ID NO: 3114 - protein, 187 aa, Artificial Sequence; identical to SEQ ID NO: 9
  Description of Artificial Sequence: Synthetic destabilizing domain (DD)

SEQ ID NO: 3115 - protein, 187 aa, Artificial Sequence; identical to SEQ ID NO: 10
  Description of Artificial Sequence: Synthetic Destabilizing Domain (DD)

SEQ ID NO: 3116 - protein, 187 aa, Artificial Sequence; identical to SEQ ID NO: 11
  Description of Artificial Sequence: Synthetic destabilizing domain (DD)

SEQ ID NO: 3117 - protein, 187 aa, Artificial Sequence; identical to SEQ ID NO: 12
  Description of Artificial Sequence: Synthetic destabilizing domain (DD)

SEQ ID NO: 3118 - protein, 186 aa, Artificial Sequence; identical to SEQ ID NO: 13
  Description of Artificial Sequence: Synthetic destabilizing domain (DD)

SEQ ID NO: 3119 - protein, 187 aa, Artificial Sequence; identical to SEQ ID NO: 14
  Description of Artificial Sequence: Synthetic destabilizing domain (DD)

SEQ ID NO: 3120 - protein, 187 aa, Artificial Sequence; identical to SEQ ID NO: 15
  Description of Artificial Sequence: Synthetic destabilizing domain (DD)

SEQ ID NO: 3121 - protein, 187 aa, Artificial Sequence; identical to SEQ ID NO: 16
  Description of Artificial Sequence: Synthetic destabilizing domain (DD)

SEQ ID NO: 3122 - protein, 187 aa, Artificial Sequence; identical to SEQ ID NO: 17
  Description of Artificial Sequence: Synthetic destabilizing domain (DD)

SEQ ID NO: 3123 - protein, 187 aa, Artificial Sequence; identical to SEQ ID NO: 18
  Description of Artificial Sequence: Synthetic destabilizing domain (DD)

SEQ ID NO: 3124 - protein, 187 aa, Artificial Sequence; identical to SEQ ID NO: 19
  Description of Artificial Sequence: Synthetic destabilizing domain (DD)

SEQ ID NO: 3125 - protein, 187 aa, Artificial Sequence; identical to SEQ ID NO: 20
  Description of Artificial Sequence: Synthetic destabilizing domain (DD)

SEQ ID NO: 3126 - protein, 187 aa, Artificial Sequence; identical to SEQ ID NO: 21
  Description of Artificial Sequence: Synthetic destabilizing domain (DD)

SEQ ID NO: 3127 - protein, 187 aa, Artificial Sequence; identical to SEQ ID NO: 22
  Description of Artificial Sequence: Synthetic destabilizing domain (DD)

SEQ ID NO: 3128 - protein, 187 aa, Artificial Sequence; identical to SEQ ID NO: 23
  Description of Artificial Sequence: Synthetic destabilizing domain (DD)

SEQ ID NO: 3129 - protein, 187 aa, Artificial Sequence; identical to SEQ ID NO: 24
  Description of Artificial Sequence: Synthetic destabilizing domain (DD)

SEQ ID NO: 3130 - protein, 187 aa, Artificial Sequence; identical to SEQ ID NO: 25
  Description of Artificial Sequence: Synthetic destabilizing domain (DD)

SEQ ID NO: 3131 - protein, 187 aa, Artificial Sequence; identical to SEQ ID NO: 26
  Description of Artificial Sequence: Synthetic destabilizing domain (DD)

SEQ ID NO: 3132 - protein, 187 aa, Artificial Sequence; identical to SEQ ID NO: 27
  Description of Artificial Sequence: Synthetic destabilizing domain (DD)

SEQ ID NO: 3133 - protein, 187 aa, Artificial Sequence; identical to SEQ ID NO: 28
  Description of Artificial Sequence: Synthetic destabilizing domain (DD)

SEQ ID NO: 3134 - protein, 187 aa, Artificial Sequence; identical to SEQ ID NO: 29
  Description of Artificial Sequence: Synthetic destabilizing domain (DD)

SEQ ID NO: 3135 - protein, 187 aa, Artificial Sequence; identical to SEQ ID NO: 30
  Description of Artificial Sequence: Synthetic destabilizing domain (DD)

SEQ ID NO: 3136 - protein, 187 aa, Artificial Sequence; identical to SEQ ID NO: 31
  Description of Artificial Sequence: Synthetic destabilizing domain (DD)

SEQ ID NO: 3137 - protein, 186 aa, Artificial Sequence; identical to SEQ ID NO: 32
  Description of Artificial Sequence: Synthetic destabilizing domain (DD)

SEQ ID NO: 3138 - protein, 186 aa, Artificial Sequence; identical to SEQ ID NO: 33
  Description of Artificial Sequence: Synthetic destabilizing domain (DD)

SEQ ID NO: 3139 - protein, 186 aa, Artificial Sequence; identical to SEQ ID NO: 34
  Description of Artificial Sequence: Synthetic destabilizing domain (DD)

SEQ ID NO: 3140 - protein, 186 aa, Artificial Sequence; identical to SEQ ID NO: 35
  Description of Artificial Sequence: Synthetic destabilizing domain (DD)

SEQ ID NO: 3141 - protein, 186 aa, Artificial Sequence; identical to SEQ ID NO: 35
  Description of Artificial Sequence: Synthetic destabilizing domain (DD)

SEQ ID NO: 3142 - protein, 186 aa, Artificial Sequence; identical to SEQ ID NO: 37
  Description of Artificial Sequence: Synthetic destabilizing domain (DD)

SEQ ID NO: 3143 - protein, 186 aa, Artificial Sequence; identical to SEQ ID NO: 38
  Description of Artificial Sequence: Synthetic destabilizing domain (DD)

SEQ ID NO: 3144 - protein, 186 aa, Artificial Sequence; identical to SEQ ID NO: 39
  Description of Artificial Sequence: Synthetic destabilizing domain (DD)

SEQ ID NO: 3145 - protein, 186 aa, Artificial Sequence; identical to SEQ ID NO: 40
  Description of Artificial Sequence: Synthetic destabilizing domain (DD)

SEQ ID NO: 3146 - protein, 186 aa, Artificial Sequence; identical to SEQ ID NO: 41
  Description of Artificial Sequence: Synthetic destabilizing domain (DD)

SEQ ID NO: 3147 - protein, 186 aa, Artificial Sequence; identical to SEQ ID NO: 42
  Description of Artificial Sequence: Synthetic destabilizing domain (DD)

SEQ ID NO: 3148 - protein, 187 aa, Artificial Sequence; identical to SEQ ID NO: 43
  Description of Artificial Sequence: Synthetic destabilizing domain (DD)

SEQ ID NO: 3149 - protein, 187 aa, Artificial Sequence; identical to SEQ ID NO: 44
  Description of Artificial Sequence: Synthetic destabilizing domain (DD)

SEQ ID NO: 3150 - protein, 187 aa, Artificial Sequence; identical to SEQ ID NO: 45
  Description of Artificial Sequence: Synthetic destabilizing domain (DD)

SEQ ID NO: 3151 - protein, 187 aa, Artificial Sequence; identical to SEQ ID NO: 46
  Description of Artificial Sequence: Synthetic destabilizing domain (DD)

SEQ ID NO: 3152 - protein, 187 aa, Artificial Sequence; identical to SEQ ID NO: 47
  Description of Artificial Sequence: Synthetic destabilizing domain (DD)

SEQ ID NO: 3153 - protein, 187 aa, Artificial Sequence; identical to SEQ ID NO: 48
  Description of Artificial Sequence: Synthetic destabilizing domain (DD)

SEQ ID NO: 3154 - protein, 187 aa, Artificial Sequence; identical to SEQ ID NO: 49
  Description of Artificial Sequence: Synthetic destabilizing domain (DD)

SEQ ID NO: 3155 - protein, 187 aa, Artificial Sequence; identical to SEQ ID NO: 50
  Description of Artificial Sequence: Synthetic destabilizing domain (DD)

SEQ ID NO: 3156 - protein, 187 aa, Artificial Sequence; identical to SEQ ID NO: 51
  Description of Artificial Sequence: Synthetic destabilizing domain (DD)

SEQ ID NO: 3157 - protein, 187 aa, Artificial Sequence; identical to SEQ ID NO: 52
  Description of Artificial Sequence: Synthetic destabilizing domain (DD)

SEQ ID NO: 3158 - protein, 187 aa, Artificial Sequence; identical to SEQ ID NO: 53
  Description of Artificial Sequence: Synthetic destabilizing domain (DD)

SEQ ID NO: 3159 - protein, 187 aa, Artificial Sequence; identical to SEQ ID NO: 54
  Description of Artificial Sequence: Synthetic destabilizing domain (DD)

SEQ ID NO: 3160 - protein, 186 aa, Artificial Sequence; identical to SEQ ID NO: 55
  Description of Artificial Sequence: Synthetic destabilizing domain (DD)

SEQ ID NO: 3161 - protein, 186 aa, Artificial Sequence; identical to SEQ ID NO: 56
  Description of Artificial Sequence: Synthetic destabilizing domain (DD)

SEQ ID NO: 3162 - protein, 186 aa, Artificial Sequence; identical to SEQ ID NO: 57
  Description of Artificial Sequence: Synthetic destabilizing domain (DD)

SEQ ID NO: 3163 - protein, 186 aa, Artificial Sequence; identical to SEQ ID NO: 1196
  Description of Artificial Sequence: Synthetic destabilizing domain (DD)

SEQ ID NO: 3164 - protein, 187 aa, Artificial Sequence; identical to SEQ ID NO: 59
  Description of Artificial Sequence: Synthetic destabilizing domain (DD)

SEQ ID NO: 3165 - protein, 187 aa, Artificial Sequence; identical to SEQ ID NO: 60
  Description of Artificial Sequence: Synthetic destabilizing domain (DD)

SEQ ID NO: 3166 - protein, 186 aa, Artificial Sequence; identical to SEQ ID NO: 61
  Description of Artificial Sequence: Synthetic destabilizing domain (DD)

SEQ ID NO: 3167 - protein, 187 aa, Artificial Sequence; identical to SEQ ID NO: 62
  Description of Artificial Sequence: Synthetic destabilizing domain (DD)

SEQ ID NO: 3168 - protein, 187 aa, Artificial Sequence; identical to SEQ ID NO: 63
  Description of Artificial Sequence: Synthetic destabilizing domain (DD)

SEQ ID NO: 3169 - protein, 187 aa, Artificial Sequence; identical to SEQ ID NO: 64
  Description of Artificial Sequence: Synthetic destabilizing domain (DD)

SEQ ID NO: 3170 - protein, 187 aa, Artificial Sequence; identical to SEQ ID NO: 65
  Description of Artificial Sequence: Synthetic destabilizing domain (DD)

SEQ ID NO: 3171 - protein, 187 aa, Artificial Sequence; identical to SEQ ID NO: 66
  Description of Artificial Sequence: Synthetic destabilizing domain (DD)

SEQ ID NO: 3172 - protein, 187 aa, Artificial Sequence; identical to SEQ ID NO: 67
  Description of Artificial Sequence: Synthetic destabilizing domain (DD)

SEQ ID NO: 3173 - protein, 187 aa, Artificial Sequence; identical to SEQ ID NO: 68
  Description of Artificial Sequence: Synthetic destabilizing domain (DD)

SEQ ID NO: 3174 - protein, 187 aa, Artificial Sequence; identical to SEQ ID NO: 69
  Description of Artificial Sequence: Synthetic destabilizing domain (DD)

SEQ ID NO: 3175 - protein, 187 aa, Artificial Sequence; identical to SEQ ID NO: 70
  Description of Artificial Sequence: Synthetic destabilizing domain (DD)

SEQ ID NO: 3176 - protein, 186 aa, Artificial Sequence; identical to SEQ ID NO: 71
  Description of Artificial Sequence: Synthetic destabilizing domain (DD)

SEQ ID NO: 3177 - DNA, 561 bp, Artificial Sequence; identical to SEQ ID NO: 72
  Description of Artificial Sequence: Synthetic destabilizing domain (DD)

SEQ ID NO: 3178 - DNA, 561 bp, Artificial Sequence; identical to SEQ ID NO: 73
  Description of Artificial Sequence: Synthetic destabilizing domain (DD)

SEQ ID NO: 3179 - DNA, 561 bp, Artificial Sequence; identical to SEQ ID NO: 74
  Description of Artificial Sequence: Synthetic destabilizing domain (DD)

SEQ ID NO: 3180 - DNA, 561 bp, Artificial Sequence; identical to SEQ ID NO: 75
  Description of Artificial Sequence: Synthetic destabilizing domain (DD)

SEQ ID NO: 3181 - DNA, 561 bp, Artificial Sequence; identical to SEQ ID NO: 76
  Description of Artificial Sequence: Synthetic destabilizing domain (DD)

SEQ ID NO: 3182 - DNA, 561 bp, Artificial Sequence; identical to SEQ ID NO: 77
  Description of Artificial Sequence: Synthetic destabilizing domain (DD)

SEQ ID NO: 3183 - DNA, 561 bp, Artificial Sequence; identical to SEQ ID NO: 78
  Description of Artificial Sequence: Synthetic destabilizing domain (DD)

SEQ ID NO: 3184 - DNA, 561 bp, Artificial Sequence; identical to SEQ ID NO: 79
  Description of Artificial Sequence: Synthetic destabilizing domain (DD)

SEQ ID NO: 3185 - DNA, 561 bp, Artificial Sequence; identical to SEQ ID NO: 80
  Description of Artificial Sequence: Synthetic destabilizing domain (DD)

SEQ ID NO: 3186 - DNA, 561 bp, Artificial Sequence; identical to SEQ ID NO: 81
  Description of Artificial Sequence: Synthetic destabilizing domain (DD)

SEQ ID NO: 3187 - DNA, 561 bp, Artificial Sequence; identical to SEQ ID NO: 82
  Description of Artificial Sequence: Synthetic destabilizing domain (DD)

SEQ ID NO: 3188 - DNA, 561 bp, Artificial Sequence; identical to SEQ ID NO: 83
  Description of Artificial Sequence: Synthetic destabilizing domain (DD)

SEQ ID NO: 3189 - DNA, 561 bp, Artificial Sequence; identical to SEQ ID NO: 84
  Description of Artificial Sequence: Synthetic destabilizing domain (DD)

SEQ ID NO: 3190 - DNA, 561 bp, Artificial Sequence; identical to SEQ ID NO: 85
  Description of Artificial Sequence: Synthetic destabilizing domain (DD)

SEQ ID NO: 3191 - DNA, 558 bp, Artificial Sequence; identical to SEQ ID NO: 86
  Description of Artificial Sequence: Synthetic destabilizing domain (DD)

SEQ ID NO: 3192 - DNA, 558 bp, Artificial Sequence; identical to SEQ ID NO: 87
  Description of Artificial Sequence: Synthetic destabilizing domain (DD)

SEQ ID NO: 3193 - DNA, 558 bp, Artificial Sequence; identical to SEQ ID NO: 88
  Description of Artificial Sequence: Synthetic destabilizing domain (DD)

SEQ ID NO: 3194 - DNA, 558 bp, Artificial Sequence; identical to SEQ ID NO: 89
  Description of Artificial Sequence: Synthetic destabilizing domain (DD)

SEQ ID NO: 3195 - DNA, 561 bp, Artificial Sequence; identical to SEQ ID NO: 90
  Description of Artificial Sequence: Synthetic destabilizing domain (DD)

SEQ ID NO: 3196 - DNA, 561 bp, Artificial Sequence; identical to SEQ ID NO: 92
  Description of Artificial Sequence: Synthetic Destabilizing Domain (DD)

SEQ ID NO: 3197 - DNA, 561 bp, Artificial Sequence; identical to SEQ ID NO: 93
  Description of Artificial Sequence: Synthetic Destabilizing Domain (DD)

SEQ ID NO: 3198 - DNA, 561 bp, Artificial Sequence; identical to SEQ ID NO: 94
  Description of Artificial Sequence: Synthetic Destabilizing Domain (DD)

SEQ ID NO: 3199 - DNA, 561 bp, Artificial Sequence; identical to SEQ ID NO: 95
  Description of Artificial Sequence: Synthetic Destabilizing Domain (DD)

SEQ ID NO: 3200 - DNA, 561 bp, Artificial Sequence; identical to SEQ ID NO: 96
  Description of Artificial Sequence: Synthetic Destabilizing Domain (DD)

SEQ ID NO: 3201 - DNA, 561 bp, Artificial Sequence; identical to SEQ ID NO: 97
  Description of Artificial Sequence: Synthetic Destabilizing Domain (DD)

SEQ ID NO: 3202 - DNA, 561 bp, Artificial Sequence; identical to SEQ ID NO: 98
  Description of Artificial Sequence: Synthetic Destabilizing Domain (DD)

SEQ ID NO: 3203 - DNA, 561 bp, Artificial Sequence; identical to SEQ ID NO: 99
  Description of Artificial Sequence: Synthetic Destabilizing Domain (DD)

SEQ ID NO: 3204 - DNA, 561 bp, Artificial Sequence; identical to SEQ ID NO: 100
  Description of Artificial Sequence: Synthetic Destabilizing Domain (DD)

SEQ ID NO: 3205 - DNA, 561 bp, Artificial Sequence; identical to SEQ ID NO: 101
  Description of Artificial Sequence: Synthetic Destabilizing Domain (DD)

SEQ ID NO: 3206 - DNA, 561 bp, Artificial Sequence; identical to SEQ ID NO: 102
  Description of Artificial Sequence: Synthetic Destabilizing Domain (DD)

SEQ ID NO: 3207 - DNA, 561 bp, Artificial Sequence; identical to SEQ ID NO: 103
  Description of Artificial Sequence: Synthetic Destabilizing Domain (DD)

SEQ ID NO: 3208 - DNA, 561 bp, Artificial Sequence; identical to SEQ ID NO: 104
  Description of Artificial Sequence: Synthetic Destabilizing Domain (DD)

SEQ ID NO: 3209 - DNA, 561 bp, Artificial Sequence; identical to SEQ ID NO: 105
  Description of Artificial Sequence: Synthetic Destabilizing Domain (DD)

SEQ ID NO: 3210 - DNA, 561 bp, Artificial Sequence; identical to SEQ ID NO: 106
  Description of Artificial Sequence: Synthetic Destabilizing Domain (DD)

SEQ ID NO: 3211 - DNA, 561 bp, Artificial Sequence; identical to SEQ ID NO: 107
  Description of Artificial Sequence: Synthetic Destabilizing Domain (DD)

SEQ ID NO: 3212 - DNA, 561 bp, Artificial Sequence; identical to SEQ ID NO: 108
  Description of Artificial Sequence: Synthetic Destabilizing Domain (DD)

SEQ ID NO: 3213 - DNA, 561 bp, Artificial Sequence; identical to SEQ ID NO: 109
  Description of Artificial Sequence: Synthetic Destabilizing Domain (DD)

SEQ ID NO: 3214 - DNA, 561 bp, Artificial Sequence; identical to SEQ ID NO: 110
  Description of Artificial Sequence: Synthetic Destabilizing Domain (DD)

SEQ ID NO: 3215 - DNA, 561 bp, Artificial Sequence; identical to SEQ ID NO: 111
  Description of Artificial Sequence: Synthetic Destabilizing Domain (DD)

SEQ ID NO: 3216 - DNA, 561 bp, Artificial Sequence; identical to SEQ ID NO: 112
  Description of Artificial Sequence: Synthetic Destabilizing Domain (DD)

SEQ ID NO: 3217 - DNA, 561 bp, Artificial Sequence; identical to SEQ ID NO: 113
  Description of Artificial Sequence: Synthetic Destabilizing Domain (DD)

SEQ ID NO: 3218 - DNA, 561 bp, Artificial Sequence; identical to SEQ ID NO: 114
  Description of Artificial Sequence: Synthetic Destabilizing Domain (DD)

SEQ ID NO: 3219 - DNA, 561 bp, Artificial Sequence; identical to SEQ ID NO: 115
  Description of Artificial Sequence: Synthetic Destabilizing Domain (DD)

SEQ ID NO: 3220 - DNA, 561 bp, Artificial Sequence; identical to SEQ ID NO: 116
  Description of Artificial Sequence: Synthetic Destabilizing Domain (DD)

SEQ ID NO: 3221 - DNA, 561 bp, Artificial Sequence; identical to SEQ ID NO: 117
  Description of Artificial Sequence: Synthetic Destabilizing Domain (DD)

SEQ ID NO: 3222 - DNA, 561 bp, Artificial Sequence; identical to SEQ ID NO: 118
  Description of Artificial Sequence: Synthetic Destabilizing Domain (DD)

SEQ ID NO: 3223 - DNA, 561 bp, Artificial Sequence; identical to SEQ ID NO: 119
  Description of Artificial Sequence: Synthetic Destabilizing Domain (DD)

SEQ ID NO: 3224 - DNA, 561 bp, Artificial Sequence; identical to SEQ ID NO: 120
  Description of Artificial Sequence: Synthetic Destabilizing Domain (DD)

SEQ ID NO: 3225 - DNA, 561 bp, Artificial Sequence; identical to SEQ ID NO: 121
  Description of Artificial Sequence: Synthetic Destabilizing Domain (DD)

SEQ ID NO: 3226 - DNA, 561 bp, Artificial Sequence; identical to SEQ ID NO: 122
  Description of Artificial Sequence: Synthetic Destabilizing Domain (DD)

SEQ ID NO: 3227 - DNA, 561 bp, Artificial Sequence; identical to SEQ ID NO: 123
  Description of Artificial Sequence: Synthetic Destabilizing Domain (DD)

SEQ ID NO: 3228 - DNA, 561 bp, Artificial Sequence; identical to SEQ ID NO: 124
  Description of Artificial Sequence: Synthetic Destabilizing Domain (DD)

SEQ ID NO: 3229 - DNA, 561 bp, Artificial Sequence; identical to SEQ ID NO: 91
  Description of Artificial Sequence: Synthetic destabilizing domain (DD)

SEQ ID NO: 3230 - DNA, 561 bp, Artificial Sequence; identical to SEQ ID NO: 92
  Description of Artificial Sequence: Synthetic destabilizing domain (DD)

SEQ ID NO: 3231 - DNA, 561 bp, Artificial Sequence; identical to SEQ ID NO: 93
  Description of Artificial Sequence: Synthetic destabilizing domain (DD)

SEQ ID NO: 3232 - DNA, 561 bp, Artificial Sequence; identical to SEQ ID NO: 94
  Description of Artificial Sequence: Synthetic destabilizing domain (DD)

SEQ ID NO: 3233 - DNA, 561 bp, Artificial Sequence; identical to SEQ ID NO: 95
  Description of Artificial Sequence: Synthetic destabilizing domain (DD)

SEQ ID NO: 3234 - DNA, 561 bp, Artificial Sequence; identical to SEQ ID NO: 96
  Description of Artificial Sequence: Synthetic destabilizing domain (DD)

SEQ ID NO: 3235 - DNA, 561 bp, Artificial Sequence; identical to SEQ ID NO: 97
  Description of Artificial Sequence: Synthetic destabilizing domain (DD)

SEQ ID NO: 3236 - DNA, 561 bp, Artificial Sequence; identical to SEQ ID NO: 98
  Description of Artificial Sequence: Synthetic destabilizing domain (DD)

SEQ ID NO: 3237 - DNA, 561 bp, Artificial Sequence; identical to SEQ ID NO: 99
  Description of Artificial Sequence: Synthetic destabilizing domain (DD)

SEQ ID NO: 3238 - DNA, 561 bp, Artificial Sequence; identical to SEQ ID NO: 100
  Description of Artificial Sequence: Synthetic destabilizing domain (DD)

SEQ ID NO: 3239 - DNA, 561 bp, Artificial Sequence; identical to SEQ ID NO: 101
  Description of Artificial Sequence: Synthetic destabilizing domain (DD)

SEQ ID NO: 3240 - DNA, 561 bp, Artificial Sequence; identical to SEQ ID NO: 102
  Description of Artificial Sequence: Synthetic destabilizing domain (DD)

SEQ ID NO: 3241 - DNA, 561 bp, Artificial Sequence; identical to SEQ ID NO: 103
  Description of Artificial Sequence: Synthetic destabilizing domain (DD)

SEQ ID NO: 3242 - DNA, 561 bp, Artificial Sequence; identical to SEQ ID NO: 104
  Description of Artificial Sequence: Synthetic destabilizing domain (DD)

SEQ ID NO: 3243 - DNA, 561 bp, Artificial Sequence; identical to SEQ ID NO: 105
  Description of Artificial Sequence: Synthetic destabilizing domain (DD)

SEQ ID NO: 3244 - DNA, 561 bp, Artificial Sequence; identical to SEQ ID NO: 106
  Description of Artificial Sequence: Synthetic destabilizing domain (DD)

SEQ ID NO: 3245 - DNA, 561 bp, Artificial Sequence; identical to SEQ ID NO: 107
  Description of Artificial Sequence: Synthetic destabilizing domain (DD)

SEQ ID NO: 3246 - protein, 187 aa, Artificial Sequence; identical to SEQ ID NO: 2
  Description of Artificial Sequence: Synthetic destabilizing domain (DD)

SEQ ID NO: 3247 - protein, 187 aa, Artificial Sequence; identical to SEQ ID NO: 3
  Description of Artificial Sequence: Synthetic destabilizing domain (DD)

SEQ ID NO: 3248 - protein, 187 aa, Artificial Sequence; identical to SEQ ID NO: 4
  Description of Artificial Sequence: Synthetic destabilizing domain (DD)

SEQ ID NO: 3249 - protein, 187 aa, Artificial Sequence; identical to SEQ ID NO: 5
  Description of Artificial Sequence: Synthetic destabilizing domain (DD)

SEQ ID NO: 3250 - protein, 187 aa, Artificial Sequence; identical to SEQ ID NO: 6
  Description of Artificial Sequence: Synthetic destabilizing domain (DD)

SEQ ID NO: 3251 - protein, 187 aa, Artificial Sequence; identical to SEQ ID NO: 7
  Description of Artificial Sequence: Synthetic destabilizing domain (DD)

SEQ ID NO: 3252 - protein, 187 aa, Artificial Sequence; identical to SEQ ID NO: 8
  Description of Artificial Sequence: Synthetic destabilizing domain (DD)

SEQ ID NO: 3253 - protein, 187 aa, Artificial Sequence; identical to SEQ ID NO: 9
  Description of Artificial Sequence: Synthetic destabilizing domain (DD)

SEQ ID NO: 3254 - protein, 187 aa, Artificial Sequence; identical to SEQ ID NO: 10
  Description of Artificial Sequence: Synthetic Destabilizing Domain (DD)

SEQ ID NO: 3255 - protein, 187 aa, Artificial Sequence; identical to SEQ ID NO: 11
  Description of Artificial Sequence: Synthetic destabilizing domain (DD)

SEQ ID NO: 3256 - protein, 187 aa, Artificial Sequence; identical to SEQ ID NO: 12
  Description of Artificial Sequence: Synthetic destabilizing domain (DD)

SEQ ID NO: 3257 - protein, 186 aa, Artificial Sequence; identical to SEQ ID NO: 13
  Description of Artificial Sequence: Synthetic destabilizing domain (DD)

SEQ ID NO: 3258 - protein, 187 aa, Artificial Sequence; identical to SEQ ID NO: 14
  Description of Artificial Sequence: Synthetic destabilizing domain (DD)

SEQ ID NO: 3259 - protein, 187 aa, Artificial Sequence; identical to SEQ ID NO: 15
  Description of Artificial Sequence: Synthetic destabilizing domain (DD)

SEQ ID NO: 3260 - protein, 187 aa, Artificial Sequence; identical to SEQ ID NO: 16
  Description of Artificial Sequence: Synthetic destabilizing domain (DD)

SEQ ID NO: 3261 - protein, 187 aa, Artificial Sequence; identical to SEQ ID NO: 17
  Description of Artificial Sequence: Synthetic destabilizing domain (DD)

SEQ ID NO: 3262 - protein, 187 aa, Artificial Sequence; identical to SEQ ID NO: 18
  Description of Artificial Sequence: Synthetic destabilizing domain (DD)

SEQ ID NO: 3263 - protein, 187 aa, Artificial Sequence; identical to SEQ ID NO: 19
  Description of Artificial Sequence: Synthetic destabilizing domain (DD)

SEQ ID NO: 3264 - protein, 187 aa, Artificial Sequence; identical to SEQ ID NO: 20
  Description of Artificial Sequence: Synthetic destabilizing domain (DD)

SEQ ID NO: 3265 - protein, 187 aa, Artificial Sequence; identical to SEQ ID NO: 21
  Description of Artificial Sequence: Synthetic destabilizing domain (DD)

SEQ ID NO: 3266 - protein, 187 aa, Artificial Sequence; identical to SEQ ID NO: 22
  Description of Artificial Sequence: Synthetic destabilizing domain (DD)

SEQ ID NO: 3267 - protein, 187 aa, Artificial Sequence; identical to SEQ ID NO: 23
  Description of Artificial Sequence: Synthetic destabilizing domain (DD)

SEQ ID NO: 3268 - protein, 187 aa, Artificial Sequence; identical to SEQ ID NO: 24
  Description of Artificial Sequence: Synthetic destabilizing domain (DD)

SEQ ID NO: 3269 - protein, 187 aa, Artificial Sequence; identical to SEQ ID NO: 25
  Description of Artificial Sequence: Synthetic destabilizing domain (DD)

SEQ ID NO: 3270 - protein, 187 aa, Artificial Sequence; identical to SEQ ID NO: 26
  Description of Artificial Sequence: Synthetic destabilizing domain (DD)

SEQ ID NO: 3271 - protein, 187 aa, Artificial Sequence; identical to SEQ ID NO: 27
  Description of Artificial Sequence: Synthetic destabilizing domain (DD)

SEQ ID NO: 3272 - protein, 187 aa, Artificial Sequence; identical to SEQ ID NO: 28
  Description of Artificial Sequence: Synthetic destabilizing domain (DD)

SEQ ID NO: 3273 - protein, 187 aa, Artificial Sequence; identical to SEQ ID NO: 29
  Description of Artificial Sequence: Synthetic destabilizing domain (DD)

SEQ ID NO: 3274 - protein, 187 aa, Artificial Sequence; identical to SEQ ID NO: 30
  Description of Artificial Sequence: Synthetic destabilizing domain (DD)

SEQ ID NO: 3275 - protein, 187 aa, Artificial Sequence; identical to SEQ ID NO: 31
  Description of Artificial Sequence: Synthetic destabilizing domain (DD)

SEQ ID NO: 3276 - protein, 186 aa, Artificial Sequence; identical to SEQ ID NO: 32
  Description of Artificial Sequence: Synthetic destabilizing domain (DD)

SEQ ID NO: 3277 - protein, 186 aa, Artificial Sequence; identical to SEQ ID NO: 33
  Description of Artificial Sequence: Synthetic destabilizing domain (DD)

SEQ ID NO: 3278 - protein, 186 aa, Artificial Sequence; identical to SEQ ID NO: 34
  Description of Artificial Sequence: Synthetic destabilizing domain (DD)

SEQ ID NO: 3279 - protein, 186 aa, Artificial Sequence; identical to SEQ ID NO: 35
  Description of Artificial Sequence: Synthetic destabilizing domain (DD)

SEQ ID NO: 3280 - protein, 186 aa, Artificial Sequence; identical to SEQ ID NO: 35
  Description of Artificial Sequence: Synthetic destabilizing domain (DD)

SEQ ID NO: 3281 - protein, 186 aa, Artificial Sequence; identical to SEQ ID NO: 37
  Description of Artificial Sequence: Synthetic destabilizing domain (DD)

SEQ ID NO: 3282 - protein, 186 aa, Artificial Sequence; identical to SEQ ID NO: 38
  Description of Artificial Sequence: Synthetic destabilizing domain (DD)

SEQ ID NO: 3283 - protein, 186 aa, Artificial Sequence; identical to SEQ ID NO: 39
  Description of Artificial Sequence: Synthetic destabilizing domain (DD)

SEQ ID NO: 3284 - protein, 186 aa, Artificial Sequence; identical to SEQ ID NO: 40
  Description of Artificial Sequence: Synthetic destabilizing domain (DD)

SEQ ID NO: 3285 - protein, 186 aa, Artificial Sequence; identical to SEQ ID NO: 41
  Description of Artificial Sequence: Synthetic destabilizing domain (DD)

SEQ ID NO: 3286 - protein, 186 aa, Artificial Sequence; identical to SEQ ID NO: 42
  Description of Artificial Sequence: Synthetic destabilizing domain (DD)

SEQ ID NO: 3287 - protein, 187 aa, Artificial Sequence; identical to SEQ ID NO: 43
  Description of Artificial Sequence: Synthetic destabilizing domain (DD)

SEQ ID NO: 3288 - protein, 187 aa, Artificial Sequence; identical to SEQ ID NO: 44
  Description of Artificial Sequence: Synthetic destabilizing domain (DD)

SEQ ID NO: 3289 - protein, 187 aa, Artificial Sequence; identical to SEQ ID NO: 45
  Description of Artificial Sequence: Synthetic destabilizing domain (DD)

SEQ ID NO: 3290 - protein, 187 aa, Artificial Sequence; identical to SEQ ID NO: 46
  Description of Artificial Sequence: Synthetic destabilizing domain (DD)

SEQ ID NO: 3291 - protein, 187 aa, Artificial Sequence; identical to SEQ ID NO: 47
  Description of Artificial Sequence: Synthetic destabilizing domain (DD)

SEQ ID NO: 3292 - protein, 187 aa, Artificial Sequence; identical to SEQ ID NO: 48
  Description of Artificial Sequence: Synthetic destabilizing domain (DD)

SEQ ID NO: 3293 - protein, 187 aa, Artificial Sequence; identical to SEQ ID NO: 49
  Description of Artificial Sequence: Synthetic destabilizing domain (DD)

SEQ ID NO: 3294 - protein, 187 aa, Artificial Sequence; identical to SEQ ID NO: 50
  Description of Artificial Sequence: Synthetic destabilizing domain (DD)

SEQ ID NO: 3295 - protein, 187 aa, Artificial Sequence; identical to SEQ ID NO: 51
  Description of Artificial Sequence: Synthetic destabilizing domain (DD)

SEQ ID NO: 3296 - protein, 187 aa, Artificial Sequence; identical to SEQ ID NO: 52
  Description of Artificial Sequence: Synthetic destabilizing domain (DD)

SEQ ID NO: 3297 - protein, 187 aa, Artificial Sequence; identical to SEQ ID NO: 53
  Description of Artificial Sequence: Synthetic destabilizing domain (DD)

SEQ ID NO: 3298 - protein, 187 aa, Artificial Sequence; identical to SEQ ID NO: 54
  Description of Artificial Sequence: Synthetic destabilizing domain (DD)

SEQ ID NO: 3299 - protein, 186 aa, Artificial Sequence; identical to SEQ ID NO: 55
  Description of Artificial Sequence: Synthetic destabilizing domain (DD)

SEQ ID NO: 3300 - protein, 186 aa, Artificial Sequence; identical to SEQ ID NO: 56
  Description of Artificial Sequence: Synthetic destabilizing domain (DD)

SEQ ID NO: 3301 - protein, 186 aa, Artificial Sequence; identical to SEQ ID NO: 57
  Description of Artificial Sequence: Synthetic destabilizing domain (DD)

SEQ ID NO: 3302 - protein, 186 aa, Artificial Sequence; identical to SEQ ID NO: 1196
  Description of Artificial Sequence: Synthetic destabilizing domain (DD)

SEQ ID NO: 3303 - protein, 187 aa, Artificial Sequence; identical to SEQ ID NO: 59
  Description of Artificial Sequence: Synthetic destabilizing domain (DD)

SEQ ID NO: 3304 - protein, 187 aa, Artificial Sequence; identical to SEQ ID NO: 60
  Description of Artificial Sequence: Synthetic destabilizing domain (DD)

SEQ ID NO: 3305 - protein, 186 aa, Artificial Sequence; identical to SEQ ID NO: 61
  Description of Artificial Sequence: Synthetic destabilizing domain (DD)

SEQ ID NO: 3306 - protein, 187 aa, Artificial Sequence; identical to SEQ ID NO: 62
  Description of Artificial Sequence: Synthetic destabilizing domain (DD)

SEQ ID NO: 3307 - protein, 187 aa, Artificial Sequence; identical to SEQ ID NO: 63
  Description of Artificial Sequence: Synthetic destabilizing domain (DD)

SEQ ID NO: 3308 - protein, 187 aa, Artificial Sequence; identical to SEQ ID NO: 64
  Description of Artificial Sequence: Synthetic destabilizing domain (DD)

SEQ ID NO: 3309 - protein, 187 aa, Artificial Sequence; identical to SEQ ID NO: 65
  Description of Artificial Sequence: Synthetic destabilizing domain (DD)

SEQ ID NO: 3310 - protein, 187 aa, Artificial Sequence; identical to SEQ ID NO: 66
  Description of Artificial Sequence: Synthetic destabilizing domain (DD)

SEQ ID NO: 3311 - protein, 187 aa, Artificial Sequence; identical to SEQ ID NO: 67
  Description of Artificial Sequence: Synthetic destabilizing domain (DD)

SEQ ID NO: 3312 - protein, 187 aa, Artificial Sequence; identical to SEQ ID NO: 68
  Description of Artificial Sequence: Synthetic destabilizing domain (DD)

SEQ ID NO: 3313 - protein, 187 aa, Artificial Sequence; identical to SEQ ID NO: 69
  Description of Artificial Sequence: Synthetic destabilizing domain (DD)

SEQ ID NO: 3314 - protein, 187 aa, Artificial Sequence; identical to SEQ ID NO: 70
  Description of Artificial Sequence: Synthetic destabilizing domain (DD)

SEQ ID NO: 3315 - protein, 186 aa, Artificial Sequence; identical to SEQ ID NO: 71
  Description of Artificial Sequence: Synthetic destabilizing domain (DD)

SEQ ID NO: 3316 - DNA, 1305 bp, Artificial Sequence; identical to SEQ ID NO: 142
  Description of Artificial Sequence: Synthetic polynucleotide

SEQ ID NO: 3317 - DNA, 1302 bp, Artificial Sequence; identical to SEQ ID NO: 143
  Description of Artificial Sequence: Synthetic polynucleotide

SEQ ID NO: 3318 - DNA, 1215 bp, Artificial Sequence; identical to SEQ ID NO: 144
  Description of Artificial Sequence: Synthetic polynucleotide

SEQ ID NO: 3319 - DNA, 1305 bp, Artificial Sequence; identical to SEQ ID NO: 145
  Description of Artificial Sequence: Synthetic polynucleotide

SEQ ID NO: 3320 - DNA, 1305 bp, Artificial Sequence; identical to SEQ ID NO: 146
  Description of Artificial Sequence: Synthetic polynucleotide

SEQ ID NO: 3321 - DNA, 1305 bp, Artificial Sequence; identical to SEQ ID NO: 147
  Description of Artificial Sequence: Synthetic polynucleotide

SEQ ID NO: 3322 - DNA, 1305 bp, Artificial Sequence; identical to SEQ ID NO: 148
  Description of Artificial Sequence: Synthetic polynucleotide

SEQ ID NO: 3323 - DNA, 1305 bp, Artificial Sequence; identical to SEQ ID NO: 149
  Description of Artificial Sequence: Synthetic polynucleotide

SEQ ID NO: 3324 - DNA, 1305 bp, Artificial Sequence; identical to SEQ ID NO: 150
  Description of Artificial Sequence: Synthetic polynucleotide

SEQ ID NO: 3325 - DNA, 1305 bp, Artificial Sequence; identical to SEQ ID NO: 151
  Description of Artificial Sequence: Synthetic polynucleotide

SEQ ID NO: 3326 - DNA, 1305 bp, Artificial Sequence; identical to SEQ ID NO: 152
  Description of Artificial Sequence: Synthetic polynucleotide

SEQ ID NO: 3327 - DNA, 1305 bp, Artificial Sequence; identical to SEQ ID NO: 153
  Description of Artificial Sequence: Synthetic polynucleotide

SEQ ID NO: 3328 - DNA, 1305 bp, Artificial Sequence; identical to SEQ ID NO: 154
  Description of Artificial Sequence: Synthetic polynucleotide

SEQ ID NO: 3329 - DNA, 1302 bp, Artificial Sequence; identical to SEQ ID NO: 155
  Description of Artificial Sequence: Synthetic polynucleotide

SEQ ID NO: 3330 - DNA, 1302 bp, Artificial Sequence; identical to SEQ ID NO: 156
  Description of Artificial Sequence: Synthetic polynucleotide

SEQ ID NO: 3331 - DNA, 1302 bp, Artificial Sequence; identical to SEQ ID NO: 157
  Description of Artificial Sequence: Synthetic polynucleotide

SEQ ID NO: 3332 - DNA, 1302 bp, Artificial Sequence; identical to SEQ ID NO: 158
  Description of Artificial Sequence: Synthetic polynucleotide

SEQ ID NO: 3333 - DNA, 1302 bp, Artificial Sequence; identical to SEQ ID NO: 159
  Description of Artificial Sequence: Synthetic polynucleotide

SEQ ID NO: 3334 - DNA, 1302 bp, Artificial Sequence; identical to SEQ ID NO: 160
  Description of Artificial Sequence: Synthetic polynucleotide

SEQ ID NO: 3335 - DNA, 1302 bp, Artificial Sequence; identical to SEQ ID NO: 161
  Description of Artificial Sequence: Synthetic polynucleotide

SEQ ID NO: 3336 - DNA, 1302 bp, Artificial Sequence; identical to SEQ ID NO: 162
  Description of Artificial Sequence: Synthetic polynucleotide

SEQ ID NO: 3337 - DNA, 1302 bp, Artificial Sequence; identical to SEQ ID NO: 161
  Description of Artificial Sequence: Synthetic polynucleotide

SEQ ID NO: 3338 - DNA, 1302 bp, Artificial Sequence; identical to SEQ ID NO: 164
  Description of Artificial Sequence: Synthetic polynucleotide

SEQ ID NO: 3339 - DNA, 2034 bp, Artificial Sequence; identical to SEQ ID NO: 165
  Description of Artificial Sequence: Synthetic polynucleotide

SEQ ID NO: 3340 - DNA, 2034 bp, Artificial Sequence; identical to SEQ ID NO: 166
  Description of Artificial Sequence: Synthetic polynucleotide

SEQ ID NO: 3341 - DNA, 2034 bp, Artificial Sequence; identical to SEQ ID NO: 167
  Description of Artificial Sequence: Synthetic polynucleotide

SEQ ID NO: 3342 - DNA, 2034 bp, Artificial Sequence; identical to SEQ ID NO: 1707
  Description of Artificial Sequence: Synthetic polynucleotide

SEQ ID NO: 3343 - DNA, 1188 bp, Artificial Sequence; identical to SEQ ID NO: 169
  Description of Artificial Sequence: Synthetic polynucleotide

SEQ ID NO: 3344 - DNA, 1752 bp, Artificial Sequence; identical to SEQ ID NO: 170
  Description of Artificial Sequence: Synthetic polynucleotide

SEQ ID NO: 3345 - DNA, 1752 bp, Artificial Sequence; identical to SEQ ID NO: 171
  Description of Artificial Sequence: Synthetic polynucleotide

SEQ ID NO: 3346 - DNA, 1623 bp, Artificial Sequence; identical to SEQ ID NO: 172
  Description of Artificial Sequence: Synthetic polynucleotide

SEQ ID NO: 3347 - DNA, 2214 bp, Artificial Sequence; identical to SEQ ID NO: 173
  Description of Artificial Sequence: Synthetic polynucleotide

SEQ ID NO: 3348 - DNA, 2062 bp, Artificial Sequence; identical to SEQ ID NO: 174
  Description of Artificial Sequence: Synthetic polynucleotide

SEQ ID NO: 3349 - DNA, 2062 bp, Artificial Sequence; identical to SEQ ID NO: 175
  Description of Artificial Sequence: Synthetic polynucleotide

SEQ ID NO: 3350 - DNA, 2061 bp, Artificial Sequence; identical to SEQ ID NO: 176
  Description of Artificial Sequence: Synthetic polynucleotide

SEQ ID NO: 3351 - DNA, 2061 bp, Artificial Sequence; identical to SEQ ID NO: 177
  Description of Artificial Sequence: Synthetic polynucleotide

SEQ ID NO: 3352 - DNA, 1824 bp, Artificial Sequence; identical to SEQ ID NO: 178
  Description of Artificial Sequence: Synthetic polynucleotide

SEQ ID NO: 3353 - DNA, 1824 bp, Artificial Sequence; identical to SEQ ID NO: 179
  Description of Artificial Sequence: Synthetic polynucleotide

SEQ ID NO: 3354 - DNA, 1824 bp, Artificial Sequence; identical to SEQ ID NO: 180
  Description of Artificial Sequence: Synthetic polynucleotide

SEQ ID NO: 3355 - DNA, 2217 bp, Artificial Sequence; identical to SEQ ID NO: 181
  Description of Artificial Sequence: Synthetic polynucleotide

SEQ ID NO: 3356 - DNA, 2217 bp, Artificial Sequence; identical to SEQ ID NO: 182
  Description of Artificial Sequence: Synthetic polynucleotide

SEQ ID NO: 3357 - DNA, 2217 bp, Artificial Sequence; identical to SEQ ID NO: 183
  Description of Artificial Sequence: Synthetic polynucleotide

SEQ ID NO: 3358 - DNA, 2217 bp, Artificial Sequence; identical to SEQ ID NO: 184
  Description of Artificial Sequence: Synthetic polynucleotide

SEQ ID NO: 3359 - DNA, 1281 bp, Artificial Sequence; identical to SEQ ID NO: 185
  Description of Artificial Sequence: Synthetic polynucleotide

SEQ ID NO: 3360 - DNA, 1302 bp, Artificial Sequence; identical to SEQ ID NO: 186
  Description of Artificial Sequence: Synthetic polynucleotide

SEQ ID NO: 3361 - DNA, 1302 bp, Artificial Sequence; identical to SEQ ID NO: 187
  Description of Artificial Sequence: Synthetic polynucleotide

SEQ ID NO: 3362 - DNA, 1302 bp, Artificial Sequence; identical to SEQ ID NO: 188
  Description of Artificial Sequence: Synthetic polynucleotide

SEQ ID NO: 3363 - DNA, 1302 bp, Artificial Sequence; identical to SEQ ID NO: 189
  Description of Artificial Sequence: Synthetic polynucleotide

SEQ ID NO: 3364 - DNA, 1302 bp, Artificial Sequence; identical to SEQ ID NO: 190
  Description of Artificial Sequence: Synthetic polynucleotide

SEQ ID NO: 3365 - DNA, 1302 bp, Artificial Sequence; identical to SEQ ID NO: 191
  Description of Artificial Sequence: Synthetic polynucleotide

SEQ ID NO: 3366 - protein, 107 aa, Homo sapiens; identical to SEQ ID NO: 192

SEQ ID NO: 3367 - protein, 187 aa, Homo sapiens; identical to SEQ ID NO: 1

SEQ ID NO: 3368 - protein, 159 aa, Escherichia coli [sequence omitted]

SEQ ID NO: 3369 - protein, 327 aa, Homo sapiens; identical to SEQ ID NO: 195

SEQ ID NO: 3370 - protein, 189 aa, Homo sapiens; identical to SEQ ID NO: 196

SEQ ID NO: 3371 - protein, 260 aa, Homo sapiens; identical to SEQ ID NO: 197

SEQ ID NO: 3372 - protein, 231 aa, Homo sapiens; identical to SEQ ID NO: 198

SEQ ID NO: 3373 - protein, 449 aa, Artificial Sequence; identical to SEQ ID NO: 199
  Description of Artificial Sequence: Synthetic heavy chain variable domain

SEQ ID NO: 3374 - protein, 223 aa, Artificial Sequence; identical to SEQ ID NO: 200
  Description of Artificial Sequence: Synthetic heavy chain variable domain

SEQ ID NO: 3375 - protein, 234 aa, Artificial Sequence; identical to SEQ ID NO: 201
  Description of Artificial Sequence: Synthetic heavy chain variable domain

SEQ ID NO: 3376 - protein, 460 aa, Artificial Sequence; identical to SEQ ID NO: 202
  Description of Artificial Sequence: Synthetic heavy chain variable domain

SEQ ID NO: 3377 - protein, 241 aa, Artificial Sequence; identical to SEQ ID NO: 203
  Description of Artificial Sequence: Synthetic heavy chain variable domain

SEQ ID NO: 3378 - protein, 471 aa, Artificial Sequence; identical to SEQ ID NO: 204
  Description of Artificial Sequence: Synthetic heavy chain variable domain

SEQ ID NO: 3379 - protein, 120 aa, Artificial Sequence; identical to SEQ ID NO: 205
  Description of Artificial Sequence: Synthetic heavy chain variable domain

SEQ ID NO: 3380 - protein, 111 aa, Artificial Sequence; identical to SEQ ID NO: 206
  Description of Artificial Sequence: Synthetic heavy chain variable domain

SEQ ID NO: 3381 - protein, 464 aa, Artificial Sequence; identical to SEQ ID NO: 207
  Description of Artificial Sequence: Synthetic heavy chain variable domain

SEQ ID NO: 3382 - protein, 137 aa, Artificial Sequence; identical to SEQ ID NO: 208
  Description of Artificial Sequence: Synthetic heavy chain variable domain

SEQ ID NO: 3383 - protein, 124 aa, Artificial Sequence; identical to SEQ ID NO: 209
  Description of Artificial Sequence: Synthetic heavy chain variable domain

SEQ ID NO: 3384 - protein, 130 aa, Artificial Sequence; identical to SEQ ID NO: 210
  Description of Artificial Sequence: Synthetic heavy chain variable domain

SEQ ID NO: 3385 - protein, 125 aa, Artificial Sequence; identical to SEQ ID NO: 211
  Description of Artificial Sequence: Synthetic heavy chain variable domain

SEQ ID NO: 3386 - protein, 125 aa, Artificial Sequence; identical to SEQ ID NO: 212
  Description of Artificial Sequence: Synthetic heavy chain variable domain

SEQ ID NO: 3387 - protein, 228 aa, Artificial Sequence; identical to SEQ ID NO: 213
  Description of Artificial Sequence: Synthetic heavy chain variable domain

SEQ ID NO: 3388 - protein, 98 aa, Artificial Sequence; identical to SEQ ID NO: 214
  Description of Artificial Sequence: Synthetic heavy chain variable domain
  MOD_RES (64)..(65): Any amino acid
  MOD_RES (68)..(69): Any amino acid
  MOD_RES (93)..(93): Any amino acid
  MOD_RES (98)..(98): Any amino acid

SEQ ID NO: 3389 - protein, 125 aa, Artificial Sequence; identical to SEQ ID NO: 215
  Description of Artificial Sequence: Synthetic heavy chain variable domain
  MOD_RES (76)..(76): Any amino acid

SEQ ID NO: 3390 - protein, 125 aa, Artificial Sequence; identical to SEQ ID NO: 216
  Description of Artificial Sequence: Synthetic heavy chain variable domain

SEQ ID NO: 3391 - protein, 125 aa, Artificial Sequence; identical to SEQ ID NO: 217
  Description of Artificial Sequence: Synthetic heavy chain variable domain

SEQ ID NO: 3392 - protein, 125 aa, Artificial Sequence; identical to SEQ ID NO: 218
  Description of Artificial Sequence: Synthetic heavy chain variable domain

SEQ ID NO: 3393 - protein, 125 aa, Artificial Sequence; identical to SEQ ID NO: 219
  Description of Artificial Sequence: Synthetic heavy chain variable domain

SEQ ID NO: 3394 - protein, 125 aa, Artificial Sequence; identical to SEQ ID NO: 220
  Description of Artificial Sequence: Synthetic heavy chain variable domain

SEQ ID NO: 3395 - protein, 125 aa, Artificial Sequence; identical to SEQ ID NO: 221
  Description of Artificial Sequence: Synthetic heavy chain variable domain

SEQ ID NO: 3396 - protein, 464 aa, Artificial Sequence; identical to SEQ ID NO: 207
  Description of Artificial Sequence: Synthetic heavy chain variable domain

SEQ ID NO: 3397 - protein, 120 aa, Artificial Sequence; identical to SEQ ID NO: 205
  Description of Artificial Sequence: Synthetic heavy chain variable domain

SEQ ID NO: 3398 - protein, 218 aa, Artificial Sequence; identical to SEQ ID NO: 224
  Description of Artificial Sequence: Synthetic heavy chain variable domain

SEQ ID NO: 3399 - protein, 219 aa, Artificial Sequence; identical to SEQ ID NO: 225
  Description of Artificial Sequence: Synthetic heavy chain variable domain

SEQ ID NO: 3400 - protein, 460 aa, Artificial Sequence; identical to SEQ ID NO: 202
  Description of Artificial Sequence: Synthetic heavy chain variable domain

SEQ ID NO: 3401 - protein, 242 aa, Artificial Sequence; identical to SEQ ID NO: 227
  Description of Artificial Sequence: Synthetic heavy chain variable domain

SEQ ID NO: 3402 - protein, 471 aa, Artificial Sequence; identical to SEQ ID NO: 204
  Description of Artificial Sequence: Synthetic heavy chain variable domain

SEQ ID NO: 3403 - protein, 118 aa, Artificial Sequence; identical to SEQ ID NO: 229
  Description of Artificial Sequence: Synthetic heavy chain variable domain

SEQ ID NO: 3404 - protein, 119 aa, Artificial Sequence; identical to SEQ ID NO: 230
  Description of Artificial Sequence: Synthetic heavy chain variable domain

SEQ ID NO: 3405 - protein, 112 aa, Artificial Sequence; identical to SEQ ID NO: 231
  Description of Artificial Sequence: Synthetic light chain variable domain

SEQ ID NO: 3406 - protein, 447 aa, Artificial Sequence; identical to SEQ ID NO: 232
  Description of Artificial Sequence: Synthetic light chain variable domain

SEQ ID NO: 3407 - protein, 111 aa, Artificial Sequence; identical to SEQ ID NO: 233
  Description of Artificial Sequence: Synthetic light chain variable domain

SEQ ID NO: 3408 - protein, 107 aa, Artificial Sequence; identical to SEQ ID NO: 234
  Description of Artificial Sequence: Synthetic light chain variable domain

SEQ ID NO: 3409 - protein, 214 aa, Artificial Sequence; identical to SEQ ID NO: 235
  Description of Artificial Sequence: Synthetic light chain variable domain

SEQ ID NO: 3410 - protein, 237 aa, Artificial Sequence; identical to SEQ ID NO: 236
  Description of Artificial Sequence: Synthetic light chain variable domain

SEQ ID NO: 3411 - protein, 107 aa, Artificial Sequence; identical to SEQ ID NO: 237
  Description of Artificial Sequence: Synthetic light chain variable domain

SEQ ID NO: 3412 - protein, 107 aa, Artificial Sequence; identical to SEQ ID NO: 237
  Description of Artificial Sequence: Synthetic light chain variable domain

SEQ ID NO: 3413 - protein, 115 aa, Artificial Sequence; identical to SEQ ID NO: 239
  Description of Artificial Sequence: Synthetic light chain variable domain

SEQ ID NO: 3414 - protein, 107 aa, Artificial Sequence; identical to SEQ ID NO: 237
  Description of Artificial Sequence: Synthetic light chain variable domain

SEQ ID NO: 3415 - protein, 112 aa, Artificial Sequence; identical to SEQ ID NO: 241
  Description of Artificial Sequence: Synthetic light chain variable domain

SEQ ID NO: 3416 - protein, 106 aa, Artificial Sequence; identical to SEQ ID NO: 242
  Description of Artificial Sequence: Synthetic light chain variable domain

SEQ ID NO: 3417 - protein, 106 aa, Artificial Sequence; identical to SEQ ID NO: 243
  Description of Artificial Sequence: Synthetic light chain variable domain

SEQ ID NO: 3418 - protein, 110 aa, Artificial Sequence; identical to SEQ ID NO: 244
  Description of Artificial Sequence: Synthetic light chain variable domain

SEQ ID NO: 3419 - protein, 109 aa, Artificial Sequence; identical to SEQ ID NO: 245
  Description of Artificial Sequence: Synthetic light chain variable domain

SEQ ID NO: 3420 - protein, 108 aa, Artificial Sequence; identical to SEQ ID NO: 246
  Description of Artificial Sequence: Synthetic light chain variable domain

SEQ ID NO: 3421 - protein, 107 aa, Artificial Sequence; identical to SEQ ID NO: 247
  Description of Artificial Sequence: Synthetic light chain variable domain

SEQ ID NO: 3422 - protein, 109 aa, Artificial Sequence; identical to SEQ ID NO: 248
  Description of Artificial Sequence: Synthetic light chain variable domain

SEQ ID NO: 3423 - protein, 109 aa, Artificial Sequence; identical to SEQ ID NO: 249
  Description of Artificial Sequence: Synthetic light chain variable domain

SEQ ID NO: 3424 - protein, 111 aa, Artificial Sequence; identical to SEQ ID NO: 250
  Description of Artificial Sequence: Synthetic light chain variable domain

SEQ ID NO: 3425 - protein, 109 aa, Artificial Sequence; identical to SEQ ID NO: 251
  Description of Artificial Sequence: Synthetic light chain variable domain
  MOD_RES (5)..(6): Any amino acid
  MOD_RES (8)..(9): Any amino acid
  MOD_RES (93)..(93): Any amino acid
  MOD_RES (104)..(104): Any amino acid

SEQ ID NO: 3426 - protein, 112 aa, Artificial Sequence; identical to SEQ ID NO: 252
  Description of Artificial Sequence: Synthetic light chain variable domain
  MOD_RES (61)..(61): Any amino acid

SEQ ID NO: 3427 - protein, 112 aa, Artificial Sequence; identical to SEQ ID NO: 253
  Description of Artificial Sequence: Synthetic light chain variable domain

SEQ ID NO: 3428 - protein, 110 aa, Artificial Sequence; identical to SEQ ID NO: 254
  Description of Artificial Sequence: Synthetic light chain variable domain

SEQ ID NO: 3429 - protein, 112 aa, Artificial Sequence; identical to SEQ ID NO: 255
  Description of Artificial Sequence: Synthetic light chain variable domain

SEQ ID NO: 3430 - protein, 111 aa, Artificial Sequence; identical to SEQ ID NO: 256
  Description of Artificial Sequence: Synthetic light chain variable domain

SEQ ID NO: 3431 - protein, 111 aa, Artificial Sequence; identical to SEQ ID NO: 257
  Description of Artificial Sequence: Synthetic light chain variable domain

SEQ ID NO: 3432 - protein, 106 aa, Artificial Sequence; identical to SEQ ID NO: 258
  Description of Artificial Sequence: Synthetic light chain variable domain

SEQ ID NO: 3433 - protein, 99 aa, Artificial Sequence; identical to SEQ ID NO: 259
  Description of Artificial Sequence: Synthetic light chain variable domain

SEQ ID NO: 3434 - protein, 110 aa, Artificial Sequence; identical to SEQ ID NO: 260
  Description of Artificial Sequence: Synthetic light chain variable domain

SEQ ID NO: 3435 - protein, 111 aa, Artificial Sequence; identical to SEQ ID NO: 261
  Description of Artificial Sequence: Synthetic light chain variable domain

SEQ ID NO: 3436 - protein, 124 aa, Artificial Sequence; identical to SEQ ID NO: 262
  Description of Artificial Sequence: Synthetic light chain variable domain

SEQ ID NO: 3437 - protein, 239 aa, Artificial Sequence; identical to SEQ ID NO: 263
  Description of Artificial Sequence: Synthetic light chain variable domain

SEQ ID NO: 3438 - protein, 111 aa, Artificial Sequence; identical to SEQ ID NO: 264
  Description of Artificial Sequence: Synthetic light chain variable domain

SEQ ID NO: 3439 - protein, 110 aa, Artificial Sequence; identical to SEQ ID NO: 265
  Description of Artificial Sequence: Synthetic light chain variable domain

SEQ ID NO: 3440 - protein, 111 aa, Artificial Sequence; identical to SEQ ID NO: 266
  Description of Artificial Sequence: Synthetic light chain variable domain

SEQ ID NO: 3441 - protein, 109 aa, Artificial Sequence; identical to SEQ ID NO: 267
  Description of Artificial Sequence: Synthetic light chain variable domain

SEQ ID NO: 3442 - protein, 108 aa, Artificial Sequence; identical to SEQ ID NO: 268
  Description of Artificial Sequence: Synthetic light chain variable domain

SEQ ID NO: 3443 - protein, 107 aa, Artificial Sequence; identical to SEQ ID NO: 269
  Description of Artificial Sequence: Synthetic light chain variable domain

SEQ ID NO: 3444 - protein, 109 aa, Artificial Sequence; identical to SEQ ID NO: 270
  Description of Artificial Sequence: Synthetic light chain variable domain

SEQ ID NO: 3445 - protein, 111 aa, Artificial Sequence; identical to SEQ ID NO: 271
  Description of Artificial Sequence: Synthetic light chain variable domain

SEQ ID NO: 3446 - protein, 121 aa, Artificial Sequence; identical to SEQ ID NO: 272
  Description of Artificial Sequence: Synthetic light chain variable domain

SEQ ID NO: 3447 - protein, 263 aa, Artificial Sequence; identical to SEQ ID NO: 273
  Description of Artificial Sequence: Synthetic single chain variable fragment

SEQ ID NO: 3448 - protein, 247 aa, Artificial Sequence; identical to SEQ ID NO: 274
  Description of Artificial Sequence: Synthetic single chain variable fragment

SEQ ID NO: 3449 - protein, 242 aa, Artificial Sequence; identical to SEQ ID NO: 275
  Description of Artificial Sequence: Synthetic single chain variable fragment

SEQ ID NO: 3450 - protein, 247 aa, Artificial Sequence; identical to SEQ ID NO: 276
  Description of Artificial Sequence: Synthetic single chain variable fragment

SEQ ID NO: 3451 - protein, 248 aa, Artificial Sequence; identical to SEQ ID NO: 277
  Description of Artificial Sequence: Synthetic single chain variable fragment

SEQ ID NO: 3452 - protein, 242 aa, Artificial Sequence; identical to SEQ ID NO: 278
  Description of Artificial Sequence: Synthetic single chain variable fragment

SEQ ID NO: 3453 - protein, 242 aa, Artificial Sequence; identical to SEQ ID NO: 279
  Description of Artificial Sequence: Synthetic single chain variable fragment

SEQ ID NO: 3454 - protein, 242 aa, Artificial Sequence; identical to SEQ ID NO: 280
  Description of Artificial Sequence: Synthetic single chain variable fragment

SEQ ID NO: 3455 - protein, 246 aa, Artificial Sequence; identical to SEQ ID NO: 281
  Description of Artificial Sequence: Synthetic single chain variable fragment

SEQ ID NO: 3456 - protein, 252 aa, Artificial Sequence; identical to SEQ ID NO: 282
  Description of Artificial Sequence: Synthetic single chain variable fragment

SEQ ID NO: 3457 - protein, 249 aa, Artificial Sequence; identical to SEQ ID NO: 283
  Description of Artificial Sequence: Synthetic single chain variable fragment

SEQ ID NO: 3458 - protein, 249 aa, Artificial Sequence; identical to SEQ ID NO: 284
  Description of Artificial Sequence: Synthetic single chain variable fragment

SEQ ID NO: 3459 - protein, 251 aa, Artificial Sequence; identical to SEQ ID NO: 285
  Description of Artificial Sequence: Synthetic single chain variable fragment

SEQ ID NO: 3460 - protein, 252 aa, Artificial Sequence; identical to SEQ ID NO: 286
  Description of Artificial Sequence: Synthetic single chain variable fragment

SEQ ID NO: 3461 - protein, 252 aa, Artificial Sequence; identical to SEQ ID NO: 286
  Description of Artificial Sequence: Synthetic single chain variable fragment

SEQ ID NO: 3462 - protein, 252 aa, Artificial Sequence; identical to SEQ ID NO: 288
  Description of Artificial Sequence: Synthetic single chain variable fragment

SEQ ID NO: 3463 - protein, 252 aa, Artificial Sequence; identical to SEQ ID NO: 288
  Description of Artificial Sequence: Synthetic single chain variable fragment

SEQ ID NO: 3464 - protein, 252 aa, Artificial Sequence; identical to SEQ ID NO: 288
  Description of Artificial Sequence: Synthetic single chain variable fragment

SEQ ID NO: 3465 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 3466 - protein, 252 aa, Artificial Sequence; identical to SEQ ID NO: 286
  Description of Artificial Sequence: Synthetic single chain variable fragment

SEQ ID NO: 3467 - protein, 250 aa, Artificial Sequence; identical to SEQ ID NO: 293
  Description of Artificial Sequence: Synthetic single chain variable fragment

SEQ ID NO: 3468 - protein, 252 aa, Artificial Sequence; identical to SEQ ID NO: 294
  Description of Artificial Sequence: Synthetic single chain variable fragment

SEQ ID NO: 3469 - protein, 236 aa, Artificial Sequence; identical to SEQ ID NO: 295
  Description of Artificial Sequence: Synthetic single chain variable fragment

SEQ ID NO: 3470 - protein, 251 aa, Artificial Sequence; identical to SEQ ID NO: 296
  Description of Artificial Sequence: Synthetic single chain variable fragment

SEQ ID NO: 3471 - protein, 246 aa, Artificial Sequence; identical to SEQ ID NO: 297
  Description of Artificial Sequence: Synthetic single chain variable fragment

SEQ ID NO: 3472 - protein, 239 aa, Artificial Sequence; identical to SEQ ID NO: 298
  Description of Artificial Sequence: Synthetic single chain variable fragment

SEQ ID NO: 3473 - protein, 250 aa, Artificial Sequence; identical to SEQ ID NO: 299
  Description of Artificial Sequence: Synthetic single chain variable fragment

SEQ ID NO: 3474 - protein, 251 aa, Artificial Sequence; identical to SEQ ID NO: 300
  Description of Artificial Sequence: Synthetic single chain variable fragment

SEQ ID NO: 3475 - protein, 242 aa, Artificial Sequence; identical to SEQ ID NO: 301
  Description of Artificial Sequence: Synthetic single chain variable fragment

SEQ ID NO: 3476 - protein, 242 aa, Artificial Sequence; identical to SEQ ID NO: 302
  Description of Artificial Sequence: Synthetic single chain variable fragment

SEQ ID NO: 3477 - protein, 246 aa, Artificial Sequence; identical to SEQ ID NO: 303
  Description of Artificial Sequence: Synthetic single chain variable fragment

SEQ ID NO: 3478 - protein, 249 aa, Artificial Sequence; identical to SEQ ID NO: 304
  Description of Artificial Sequence: Synthetic single chain variable fragment

SEQ ID NO: 3479 - protein, 249 aa, Artificial Sequence; identical to SEQ ID NO: 305
  Description of Artificial Sequence: Synthetic single chain variable fragment

SEQ ID NO: 3480 - protein, 252 aa, Artificial Sequence; identical to SEQ ID NO: 288
  Description of Artificial Sequence: Synthetic single chain variable fragment

SEQ ID NO: 3481 - protein, 495 aa, Artificial Sequence; identical to SEQ ID NO: 307
  Description of Artificial Sequence: Synthetic single chain variable fragment

SEQ ID NO: 3482 - protein, 247 aa, Artificial Sequence; identical to SEQ ID NO: 308
  Description of Artificial Sequence: Synthetic single chain variable fragment

SEQ ID NO: 3483 - protein, 251 aa, Artificial Sequence; identical to SEQ ID NO: 309
  Description of Artificial Sequence: Synthetic single chain variable fragment

SEQ ID NO: 3484 - protein, 250 aa, Artificial Sequence; identical to SEQ ID NO: 310
  Description of Artificial Sequence: Synthetic single chain variable fragment

SEQ ID NO: 3485 - protein, 247 aa, Artificial Sequence; identical to SEQ ID NO: 311
  Description of Artificial Sequence: Synthetic single chain variable fragment

SEQ ID NO: 3486 - protein, 248 aa, Artificial Sequence; identical to SEQ ID NO: 312
  Description of Artificial Sequence: Synthetic single chain variable fragment

SEQ ID NO: 3487 - protein, 242 aa, Artificial Sequence; identical to SEQ ID NO: 313
  Description of Artificial Sequence: Synthetic single chain variable fragment

SEQ ID NO: 3488 - protein, 251 aa, Artificial Sequence; identical to SEQ ID NO: 314
  Description of Artificial Sequence: Synthetic single chain variable fragment

SEQ ID NO: 3489 - protein, 247 aa, Artificial Sequence; identical to SEQ ID NO: 315
  Description of Artificial Sequence: Synthetic single chain variable fragment

SEQ ID NO: 3490 - protein, 250 aa, Artificial Sequence; identical to SEQ ID NO: 316
  Description of Artificial Sequence: Synthetic single chain variable fragment

SEQ ID NO: 3491 - protein, 252 aa, Artificial Sequence; identical to SEQ ID NO: 317
  Description of Artificial Sequence: Synthetic single chain variable fragment

SEQ ID NO: 3492 - protein, 247 aa, Artificial Sequence; identical to SEQ ID NO: 318
  Description of Artificial Sequence: Synthetic single chain variable fragment

SEQ ID NO: 3493 - protein, 247 aa, Artificial Sequence; identical to SEQ ID NO: 319
  Description of Artificial Sequence: Synthetic single chain variable fragment

SEQ ID NO: 3494 - protein, 249 aa, Artificial Sequence; identical to SEQ ID NO: 320
  Description of Artificial Sequence: Synthetic single chain variable fragment

SEQ ID NO: 3495 - protein, 251 aa, Artificial Sequence; identical to SEQ ID NO: 321
  Description of Artificial Sequence: Synthetic single chain variable fragment

SEQ ID NO: 3496 - protein, 247 aa, Artificial Sequence; identical to SEQ ID NO: 322
  Description of Artificial Sequence: Synthetic single chain variable fragment

SEQ ID NO: 3497 - protein, 241 aa, Artificial Sequence; identical to SEQ ID NO: 323
  Description of Artificial Sequence: Synthetic single chain variable fragment

SEQ ID NO: 3498 - protein, 248 aa, Artificial Sequence; identical to SEQ ID NO: 277
  Description of Artificial Sequence: Synthetic single chain variable fragment

SEQ ID NO: 3499 - protein, 246 aa, Artificial Sequence; identical to SEQ ID NO: 281
  Description of Artificial Sequence: Synthetic single chain variable fragment

SEQ ID NO: 3500 - protein, 252 aa, Artificial Sequence; identical to SEQ ID NO: 282
  Description of Artificial Sequence: Synthetic single chain variable fragment

SEQ ID NO: 3501 - protein, 249 aa, Artificial Sequence; identical to SEQ ID NO: 283
  Description of Artificial Sequence: Synthetic single chain variable fragment

SEQ ID NO: 3502 - protein, 249 aa, Artificial Sequence; identical to SEQ ID NO: 284
  Description of Artificial Sequence: Synthetic single chain variable fragment

SEQ ID NO: 3503 - protein, 251 aa, Artificial Sequence; identical to SEQ ID NO: 285
  Description of Artificial Sequence: Synthetic single chain variable fragment

SEQ ID NO: 3504 - protein, 252 aa, Artificial Sequence; identical to SEQ ID NO: 286
  Description of Artificial Sequence: Synthetic single chain variable fragment

SEQ ID NO: 3505 - protein, 252 aa, Artificial Sequence; identical to SEQ ID NO: 286
  Description of Artificial Sequence: Synthetic single chain variable fragment

SEQ ID NO: 3506 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 3507 - protein, 252 aa, Artificial Sequence; identical to SEQ ID NO: 288
  Description of Artificial Sequence: Synthetic single chain variable fragment

SEQ ID NO: 3508 - protein, 252 aa, Artificial Sequence; identical to SEQ ID NO: 288
  Description of Artificial Sequence: Synthetic single chain variable fragment

SEQ ID NO: 3509 - protein, 252 aa, Artificial Sequence; identical to SEQ ID NO: 288
  Description of Artificial Sequence: Synthetic single chain variable fragment

SEQ ID NO: 3510 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 3511 - protein, 252 aa, Artificial Sequence; identical to SEQ ID NO: 286
  Description of Artificial Sequence: Synthetic single chain variable fragment

SEQ ID NO: 3512 - protein, 250 aa, Artificial Sequence; identical to SEQ ID NO: 293
  Description of Artificial Sequence: Synthetic single chain variable fragment

SEQ ID NO: 3513 - protein, 252 aa, Artificial Sequence; identical to SEQ ID NO: 294
  Description of Artificial Sequence: Synthetic single chain variable fragment

SEQ ID NO: 3514 - protein, 236 aa, Artificial Sequence; identical to SEQ ID NO: 295
  Description of Artificial Sequence: Synthetic single chain variable fragment

SEQ ID NO: 3515 - protein, 251 aa, Artificial Sequence; identical to SEQ ID NO: 296
  Description of Artificial Sequence: Synthetic single chain variable fragment

SEQ ID NO: 3516 - protein, 246 aa, Artificial Sequence; identical to SEQ ID NO: 297
  Description of Artificial Sequence: Synthetic single chain variable fragment

SEQ ID NO: 3517 - protein, 239 aa, Artificial Sequence; identical to SEQ ID NO: 298
  Description of Artificial Sequence: Synthetic single chain variable fragment

SEQ ID NO: 3518 - protein, 250 aa, Artificial Sequence; identical to SEQ ID NO: 299
  Description of Artificial Sequence: Synthetic single chain variable fragment

SEQ ID NO: 3519 - protein, 251 aa, Artificial Sequence; identical to SEQ ID NO: 300
  Description of Artificial Sequence: Synthetic single chain variable fragment

SEQ ID NO: 3520 - protein, 273 aa, Artificial Sequence; identical to SEQ ID NO: 346
  Description of Artificial Sequence: Synthetic single chain variable fragment

SEQ ID NO: 3521 - protein, 270 aa, Artificial Sequence; identical to SEQ ID NO: 347
  Description of Artificial Sequence: Synthetic single chain variable fragment

SEQ ID NO: 3522 - protein, 277 aa, Artificial Sequence; identical to SEQ ID NO: 348
  Description of Artificial Sequence: Synthetic single chain variable fragment

SEQ ID NO: 3523 - protein, 246 aa, Artificial Sequence; identical to SEQ ID NO: 303
  Description of Artificial Sequence: Synthetic single chain variable fragment

SEQ ID NO: 3524 - protein, 249 aa, Artificial Sequence; identical to SEQ ID NO: 304
  Description of Artificial Sequence: Synthetic single chain variable fragment

SEQ ID NO: 3525 - protein, 249 aa, Artificial Sequence; identical to SEQ ID NO: 305
  Description of Artificial Sequence: Synthetic single chain variable fragment

SEQ ID NO: 3526 - protein, 252 aa, Artificial Sequence; identical to SEQ ID NO: 288
  Description of Artificial Sequence: Synthetic single chain variable fragment

SEQ ID NO: 3527 - protein, 251 aa, Artificial Sequence; identical to SEQ ID NO: 309
  Description of Artificial Sequence: Synthetic single chain variable fragment

SEQ ID NO: 3528 - protein, 250 aa, Artificial Sequence; identical to SEQ ID NO: 310
  Description of Artificial Sequence: Synthetic single chain variable fragment

SEQ ID NO: 3529 - protein, 247 aa, Artificial Sequence; identical to SEQ ID NO: 311
  Description of Artificial Sequence: Synthetic single chain variable fragment

SEQ ID NO: 3530 - protein, 248 aa, Artificial Sequence; identical to SEQ ID NO: 312
  Description of Artificial Sequence: Synthetic single chain variable fragment

SEQ ID NO: 3531 - protein, 251 aa, Artificial Sequence; identical to SEQ ID NO: 314
  Description of Artificial Sequence: Synthetic single chain variable fragment

SEQ ID NO: 3532 - protein, 250 aa, Artificial Sequence; identical to SEQ ID NO: 316
  Description of Artificial Sequence: Synthetic single chain variable fragment

SEQ ID NO: 3533 - protein, 249 aa, Artificial Sequence; identical to SEQ ID NO: 320
  Description of Artificial Sequence: Synthetic single chain variable fragment

SEQ ID NO: 3534 - protein, 251 aa, Artificial Sequence; identical to SEQ ID NO: 321
  Description of Artificial Sequence: Synthetic single chain variable fragment

SEQ ID NO: 3535 - protein, 249 aa, Artificial Sequence; identical to SEQ ID NO: 284
  Description of Artificial Sequence: Synthetic single chain variable fragment

SEQ ID NO: 3536 - protein, 242 aa, Artificial Sequence; identical to SEQ ID NO: 275
  Description of Artificial Sequence: Synthetic single chain variable fragment

SEQ ID NO: 3537 - protein, 245 aa, Artificial Sequence; identical to SEQ ID NO: 363
  Description of Artificial Sequence: Synthetic single chain variable fragment

SEQ ID NO: 3538 - protein, 119 aa, Artificial Sequence; identical to SEQ ID NO: 364
  Description of Artificial Sequence: Synthetic single chain variable fragment

SEQ ID NO: 3539 - protein, 438 aa, Artificial Sequence; identical to SEQ ID NO: 365
  Description of Artificial Sequence: Synthetic single chain variable fragment

SEQ ID NO: 3540 - protein, 272 aa, Artificial Sequence; identical to SEQ ID NO: 366
  Description of Artificial Sequence: Synthetic single chain variable fragment

SEQ ID NO: 3541 - protein, 267 aa, Artificial Sequence; identical to SEQ ID NO: 367
  Description of Artificial Sequence: Synthetic single chain variable fragment

SEQ ID NO: 3542 - protein, 270 aa, Artificial Sequence; identical to SEQ ID NO: 347
  Description of Artificial Sequence: Synthetic single chain variable fragment

SEQ ID NO: 3543 - protein, 277 aa, Artificial Sequence; identical to SEQ ID NO: 348
  Description of Artificial Sequence: Synthetic single chain variable fragment

SEQ ID NO: 3544 - protein, 242 aa, Artificial Sequence; identical to SEQ ID NO: 280
  Description of Artificial Sequence: Synthetic single chain variable fragment

SEQ ID NO: 3545 - protein, 242 aa, Artificial Sequence; identical to SEQ ID NO: 301
  Description of Artificial Sequence: Synthetic single chain variable fragment

SEQ ID NO: 3546 - protein, 242 aa, Artificial Sequence; identical to SEQ ID NO: 302
  Description of Artificial Sequence: Synthetic single chain variable fragment

SEQ ID NO: 3547 - protein, 247 aa, Artificial Sequence; identical to SEQ ID NO: 308
  Description of Artificial Sequence: Synthetic single chain variable fragment

SEQ ID NO: 3548 - protein, 247 aa, Artificial Sequence; identical to SEQ ID NO: 315
  Description of Artificial Sequence: Synthetic single chain variable fragment

SEQ ID NO: 3549 - protein, 247 aa, Artificial Sequence; identical to SEQ ID NO: 318
  Description of Artificial Sequence: Synthetic single chain variable fragment

SEQ ID NO: 3550 - protein, 247 aa, Artificial Sequence; identical to SEQ ID NO: 319
  Description of Artificial Sequence: Synthetic single chain variable fragment

SEQ ID NO: 3551 - protein, 247 aa, Artificial Sequence; identical to SEQ ID NO: 322
  Description of Artificial Sequence: Synthetic single chain variable fragment

SEQ ID NO: 3552 - protein, 247 aa, Artificial Sequence; identical to SEQ ID NO: 276
  Description of Artificial Sequence: Synthetic single chain variable fragment

SEQ ID NO: 3553 - protein, 242 aa, Artificial Sequence; identical to SEQ ID NO: 278
  Description of Artificial Sequence: Synthetic single chain variable fragment

SEQ ID NO: 3554 - protein, 495 aa, Artificial Sequence; identical to SEQ ID NO: 307
  Description of Artificial Sequence: Synthetic single chain variable fragment

SEQ ID NO: 3555 - protein, 242 aa, Artificial Sequence; identical to SEQ ID NO: 279
  Description of Artificial Sequence: Synthetic single chain variable fragment

SEQ ID NO: 3556 - protein, 242 aa, Artificial Sequence; identical to SEQ ID NO: 313
  Description of Artificial Sequence: Synthetic single chain variable fragment

SEQ ID NO: 3557 - protein, 252 aa, Artificial Sequence; identical to SEQ ID NO: 317
  Description of Artificial Sequence: Synthetic single chain variable fragment

SEQ ID NO: 3558 - protein, 250 aa, Artificial Sequence; identical to SEQ ID NO: 384
  Description of Artificial Sequence: Synthetic single chain variable fragment

SEQ ID NO: 3559 - protein, 242 aa, Artificial Sequence; identical to SEQ ID NO: 313
  Description of Artificial Sequence: Synthetic single chain variable fragment

SEQ ID NO: 3560 - protein, 251 aa, Artificial Sequence; identical to SEQ ID NO: 386
  Description of Artificial Sequence: Synthetic single chain variable fragment

SEQ ID NO: 3561 - protein, 271 aa, Artificial Sequence; identical to SEQ ID NO: 387
  Description of Artificial Sequence: Synthetic single chain variable fragment

SEQ ID NO: 3562 - protein, 248 aa, Artificial Sequence; identical to SEQ ID NO: 277
  Description of Artificial Sequence: Synthetic single chain variable fragment

SEQ ID NO: 3563 - protein, 246 aa, Artificial Sequence; identical to SEQ ID NO: 281
  Description of Artificial Sequence: Synthetic single chain variable fragment

SEQ ID NO: 3564 - protein, 252 aa, Artificial Sequence; identical to SEQ ID NO: 282
  Description of Artificial Sequence: Synthetic single chain variable fragment

SEQ ID NO: 3565 - protein, 249 aa, Artificial Sequence; identical to SEQ ID NO: 283
  Description of Artificial Sequence: Synthetic single chain variable fragment

SEQ ID NO: 3566 - protein, 251 aa, Artificial Sequence; identical to SEQ ID NO: 285
  Description of Artificial Sequence: Synthetic single chain variable fragment

SEQ ID NO: 3567 - protein, 252 aa, Artificial Sequence; identical to SEQ ID NO: 286
  Description of Artificial Sequence: Synthetic single chain variable fragment

SEQ ID NO: 3568 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 3569 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 3570 - protein, 250 aa, Artificial Sequence; identical to SEQ ID NO: 293
  Description of Artificial Sequence: Synthetic single chain variable fragment

SEQ ID NO: 3571 - protein, 252 aa, Artificial Sequence; identical to SEQ ID NO: 294
  Description of Artificial Sequence: Synthetic single chain variable fragment

SEQ ID NO: 3572 - protein, 236 aa, Artificial Sequence; identical to SEQ ID NO: 295
  Description of Artificial Sequence: Synthetic single chain variable fragment

SEQ ID NO: 3573 - protein, 251 aa, Artificial Sequence; identical to SEQ ID NO: 296
  Description of Artificial Sequence: Synthetic single chain variable fragment

SEQ ID NO: 3574 - protein, 246 aa, Artificial Sequence; identical to SEQ ID NO: 297
  Description of Artificial Sequence: Synthetic single chain variable fragment

SEQ ID NO: 3575 - protein, 239 aa, Artificial Sequence; identical to SEQ ID NO: 298
  Description of Artificial Sequence: Synthetic single chain variable fragment

SEQ ID NO: 3576 - protein, 250 aa, Artificial Sequence; identical to SEQ ID NO: 299
  Description of Artificial Sequence: Synthetic single chain variable fragment

SEQ ID NO: 3577 - protein, 251 aa, Artificial Sequence; identical to SEQ ID NO: 300
  Description of Artificial Sequence: Synthetic single chain variable fragment

SEQ ID NO: 3578 - protein, 246 aa, Artificial Sequence; identical to SEQ ID NO: 303
  Description of Artificial Sequence: Synthetic single chain variable fragment

SEQ ID NO: 3579 - protein, 249 aa, Artificial Sequence; identical to SEQ ID NO: 304
  Description of Artificial Sequence: Synthetic single chain variable fragment

SEQ ID NO: 3580 - protein, 249 aa, Artificial Sequence; identical to SEQ ID NO: 305
  Description of Artificial Sequence: Synthetic single chain variable fragment

SEQ ID NO: 3581 - protein, 252 aa, Artificial Sequence; identical to SEQ ID NO: 288
  Description of Artificial Sequence: Synthetic single chain variable fragment

SEQ ID NO: 3582 - protein, 251 aa, Artificial Sequence; identical to SEQ ID NO: 309
  Description of Artificial Sequence: Synthetic single chain variable fragment

SEQ ID NO: 3583 - protein, 250 aa, Artificial Sequence; identical to SEQ ID NO: 310
  Description of Artificial Sequence: Synthetic single chain variable fragment

SEQ ID NO: 3584 - protein, 247 aa, Artificial Sequence; identical to SEQ ID NO: 311
  Description of Artificial Sequence: Synthetic single chain variable fragment

SEQ ID NO: 3585 - protein, 248 aa, Artificial Sequence; identical to SEQ ID NO: 312
  Description of Artificial Sequence: Synthetic single chain variable fragment

SEQ ID NO: 3586 - protein, 251 aa, Artificial Sequence; identical to SEQ ID NO: 314
  Description of Artificial Sequence: Synthetic single chain variable fragment

SEQ ID NO: 3587 - protein, 250 aa, Artificial Sequence; identical to SEQ ID NO: 316
  Description of Artificial Sequence: Synthetic single chain variable fragment

SEQ ID NO: 3588 - protein, 249 aa, Artificial Sequence; identical to SEQ ID NO: 320
  Description of Artificial Sequence: Synthetic single chain variable fragment

SEQ ID NO: 3589 - protein, 251 aa, Artificial Sequence; identical to SEQ ID NO: 321
  Description of Artificial Sequence: Synthetic single chain variable fragment

SEQ ID NO: 3590 - protein, 249 aa, Artificial Sequence; identical to SEQ ID NO: 284
  Description of Artificial Sequence: Synthetic single chain variable fragment

SEQ ID NO: 3591 - protein, 277 aa, Artificial Sequence; identical to SEQ ID NO: 417
  Description of Artificial Sequence: Synthetic single chain variable fragment

SEQ ID NO: 3592 - protein, 242 aa, Artificial Sequence; identical to SEQ ID NO: 313
  Description of Artificial Sequence: Synthetic CD19 scFv

SEQ ID NO: 3593 - protein, 112 aa, Homo sapiens; identical to SEQ ID NO: 419

SEQ ID NO: 3594 - DNA, 726 bp, Artificial Sequence; identical to SEQ ID NO: 420
  Description of Artificial Sequence: Synthetic CD19 scFv sequence

SEQ ID NO: 3595 - protein, 46 aa, Homo sapiens; identical to SEQ ID NO: 528

SEQ ID NO: 3596 - protein, 31 aa, Homo sapiens; identical to SEQ ID NO: 529

SEQ ID NO: 3597 - protein, 27 aa, Homo sapiens
IISFFLALTSTALLFLLFFLTLRFSVV

SEQ ID NO: 3598 - protein, 26 aa, Homo sapiens
VAAILGLGLVLGLLGPLAILLALYLL

SEQ ID NO: 3599 - protein, 363 aa, Homo sapiens; identical to SEQ ID NO: 532

SEQ ID NO: 3600 - protein, 21 aa, Homo sapiens
AVFGCIFGALVIVTVGGFIFW

SEQ ID NO: 3601 - protein, 185 aa, Homo sapiens; identical to SEQ ID NO: 534

SEQ ID NO: 3602 - protein, 106 aa, Homo sapiens; identical to SEQ ID NO: 535

SEQ ID NO: 3603 - protein, 27 aa, Homo sapiens
FWVLVVVGGVLACYSLLVTVAFIIFWV

SEQ ID NO: 3604 - protein, 66 aa, Homo sapiens; identical to SEQ ID NO: 537

SEQ ID NO: 3605 - protein, 33 aa, Homo sapiens; identical to SEQ ID NO: 538

SEQ ID NO: 3606 - protein, 68 aa, Homo sapiens; identical to SEQ ID NO: 449

SEQ ID NO: 3607 - protein, 28 aa, Homo sapiens
MFWVLVVVGGVLACYSLLVTVAFIIFWV

SEQ ID NO: 3608 - protein, 26 aa, Homo sapiens
FWVLVVVGGVLACYSLLVTVAFHFWV

SEQ ID NO: 3609 - protein, 28 aa, Homo sapiens
MFWVLVVVGGVLACYSGGVTVAFIIFWV

SEQ ID NO: 3610 - protein, 26 aa, Homo sapiens
WVLVVVGGVLACYSLLVTVAFIIFWV

SEQ ID NO: 3611 - protein, 69 aa, Homo sapiens; identical to SEQ ID NO: 544

SEQ ID NO: 3612 - protein, 180 aa, Homo sapiens; identical to SEQ ID NO: 545

SEQ ID NO: 3613 - protein, 216 aa, Homo sapiens; identical to SEQ ID NO: 546

SEQ ID NO: 3614 - protein, 140 aa, Homo sapiens; identical to SEQ ID NO: 547

SEQ ID NO: 3615 - protein, 222 aa, Homo sapiens; identical to SEQ ID NO: 454

SEQ ID NO: 3616 - protein, 23 aa, Homo sapiens
LCYLLDGILFIYGVILTALFLRV

SEQ ID NO: 3617 - protein, 51 aa, Homo sapiens; identical to SEQ ID NO: 550

SEQ ID NO: 3618 - protein, 21 aa, Homo sapiens
LCYLLDGILFIYGVILTALFL

SEQ ID NO: 3619 - protein, 25 aa, Homo sapiens
ALIVLGGVAGLLLFIGLGIFFCVRC

SEQ ID NO: 3620 - protein, 22 aa, Homo sapiens
MALIVLGGVAGLLLFIGLGIFF

SEQ ID NO: 3621 - protein, 725 aa, Homo sapiens; identical to SEQ ID NO: 554

SEQ ID NO: 3622 - protein, 23 aa, Homo sapiens
PLFIPVAVMVTAFSGLAFIIWLA

SEQ ID NO: 3623 - protein, 24 aa, Homo sapiens
ALPAALAVISFLLGLGLGVACVLA

SEQ ID NO: 3624 - protein, 21 aa, Homo sapiens
MALPVTALLLPLALLLHAARP

SEQ ID NO: 3625 - protein, 286 aa, Homo sapiens; identical to SEQ ID NO: 558

SEQ ID NO: 3626 - protein, 226 aa, Homo sapiens; identical to SEQ ID NO: 559

SEQ ID NO: 3627 - protein, 83 aa, Homo sapiens; identical to SEQ ID NO: 560

SEQ ID NO: 3628 - protein, 22 aa, Homo sapiens
IWAPLAGTCGVLLLSLVITLYC

SEQ ID NO: 3629 - protein, 24 aa, Homo sapiens
IYIWAPLAGTCGVLLLSLVITLYC

SEQ ID NO: 3630 - protein, 25 aa, Homo sapiens
IYIWAPLAGTCGVLLLSLVITLYCR

SEQ ID NO: 3631 - protein, 71 aa, Homo sapiens; identical to SEQ ID NO: 564

SEQ ID NO: 3632 - protein, 25 aa, Homo sapiens
IYIWAPLAGTCGVLLLSLVITLVCR

SEQ ID NO: 3633 - protein, 21 aa, Homo sapiens
IYIWAPLAGTCGVLLLSLVIT

SEQ ID NO: 3634 - protein, 23 aa, Homo sapiens
IYIWAPLAGTCGVLLLSLVITLY

SEQ ID NO: 3635 - protein, 101 aa, Homo sapiens; identical to SEQ ID NO: 568

SEQ ID NO: 3636 - protein, 52 aa, Homo sapiens; identical to SEQ ID NO: 569

SEQ ID NO: 3637 - protein, 257 aa, Homo sapiens; identical to SEQ ID NO: 570

SEQ ID NO: 3638 - protein, 244 aa, Homo sapiens; identical to SEQ ID NO: 571

SEQ ID NO: 3639 - protein, 86 aa, Homo sapiens; identical to SEQ ID NO: 524

SEQ ID NO: 3640 - protein, 54 aa, Homo sapiens; identical to SEQ ID NO: 573

SEQ ID NO: 3641 - protein, 31 aa, Homo sapiens; identical to SEQ ID NO: 574

SEQ ID NO: 3642 - protein, 24 aa, Homo sapiens
SIISAVVGILLVVVLGVVFGILII

SEQ ID NO: 3643 - protein, 113 aa, Homo sapiens; identical to SEQ ID NO: 576

SEQ ID NO: 3644 - protein, 21 aa, Homo sapiens
FLVIIVILSALFLGTLACFCV

SEQ ID NO: 3645 - protein, 68 aa, Homo sapiens; identical to SEQ ID NO: 578

SEQ ID NO: 3646 - protein, 106 aa, Homo sapiens; identical to SEQ ID NO: 579

SEQ ID NO: 3647 - protein, 28 aa, Homo sapiens
FWVLVVVGGVLACYSLLVTVAFIIFWVR

SEQ ID NO: 3648 - protein, 73 aa, Homo sapiens; identical to SEQ ID NO: 581

SEQ ID NO: 3649 - protein, 23 aa, Homo sapiens
LGLLVAGVLVLLVSLGVAIHLCC

SEQ ID NO: 3650 - protein, 27 aa, Homo sapiens
ILLAGLVAADAVASLLIVGAVFLCARR

SEQ ID NO: 3651 - protein, 21 aa, Homo sapiens
FWLPIGCAAFVVVCILGCILI

SEQ ID NO: 3652 - protein, 233 aa, Homo sapiens; identical to SEQ ID NO: 585

SEQ ID NO: 3653 - protein, 21 aa, Homo sapiens
LLFLILGVLSLLLLVTGAFGF

SEQ ID NO: 3654 - protein, 21 aa, Homo sapiens
VAAILGLGLVLGLLGPLAILL

SEQ ID NO: 3655 - protein, 20 aa, Homo sapiens
VGWGGLLGSLVLLVWVLAVI

SEQ ID NO: 3656 - protein, 27 aa, Homo sapiens
FWALVVVAGVLFCYGLLVTVALCVIWT

SEQ ID NO: 3657 - protein, 449 aa, Artificial Sequence; identical to SEQ ID NO: 199
  Description of Artificial Sequence: Synthetic heavy chain variable domain

SEQ ID NO: 3658 - protein, 223 aa, Artificial Sequence; identical to SEQ ID NO: 200
  Description of Artificial Sequence: Synthetic heavy chain variable domain

SEQ ID NO: 3659 - protein, 234 aa, Artificial Sequence; identical to SEQ ID NO: 201
  Description of Artificial Sequence: Synthetic heavy chain variable domain

SEQ ID NO: 3660 - protein, 460 aa, Artificial Sequence; identical to SEQ ID NO: 202
  Description of Artificial Sequence: Synthetic heavy chain variable domain

SEQ ID NO: 3661 - protein, 241 aa, Artificial Sequence; identical to SEQ ID NO: 203
  Description of Artificial Sequence: Synthetic heavy chain variable domain

SEQ ID NO: 3662 - protein, 471 aa, Artificial Sequence; identical to SEQ ID NO: 204
  Description of Artificial Sequence: Synthetic heavy chain variable domain

SEQ ID NO: 3663 - protein, 120 aa, Artificial Sequence; identical to SEQ ID NO: 205
  Description of Artificial Sequence: Synthetic heavy chain variable domain

SEQ ID NO: 3664 - protein, 111 aa, Artificial Sequence; identical to SEQ ID NO: 206
  Description of Artificial Sequence: Synthetic heavy chain variable domain

SEQ ID NO: 3665 - protein, 464 aa, Artificial Sequence; identical to SEQ ID NO: 207
  Description of Artificial Sequence: Synthetic heavy chain variable domain

SEQ ID NO: 3666 - protein, 137 aa, Artificial Sequence; identical to SEQ ID NO: 208
  Description of Artificial Sequence: Synthetic heavy chain variable domain

SEQ ID NO: 3667 - protein, 124 aa, Artificial Sequence; identical to SEQ ID NO: 209
  Description of Artificial Sequence: Synthetic heavy chain variable domain

SEQ ID NO: 3668 - protein, 130 aa, Artificial Sequence; identical to SEQ ID NO: 210
  Description of Artificial Sequence: Synthetic heavy chain variable domain

SEQ ID NO: 3669 - protein, 125 aa, Artificial Sequence; identical to SEQ ID NO: 211
  Description of Artificial Sequence: Synthetic heavy chain variable domain

SEQ ID NO: 3670 - protein, 125 aa, Artificial Sequence; identical to SEQ ID NO: 212
  Description of Artificial Sequence: Synthetic heavy chain variable domain

SEQ ID NO: 3671 - protein, 228 aa, Artificial Sequence; identical to SEQ ID NO: 213
  Description of Artificial Sequence: Synthetic heavy chain variable domain

SEQ ID NO: 3672 - protein, 98 aa, Artificial Sequence; identical to SEQ ID NO: 214
  Description of Artificial Sequence: Synthetic heavy chain variable domain
  MOD_RES (64)..(65): Any amino acid
  MOD_RES (68)..(69): Any amino acid
  MOD_RES (93)..(93): Any amino acid
  MOD_RES (98)..(98): Any amino acid

SEQ ID NO: 3673 - protein, 125 aa, Artificial Sequence; identical to SEQ ID NO: 215
  Description of Artificial Sequence: Synthetic heavy chain variable domain
  MOD_RES (76)..(76): Any amino acid

SEQ ID NO: 3674 - protein, 125 aa, Artificial Sequence; identical to SEQ ID NO: 216
  Description of Artificial Sequence: Synthetic heavy chain variable domain

SEQ ID NO: 3675 - protein, 125 aa, Artificial Sequence; identical to SEQ ID NO: 217
  Description of Artificial Sequence: Synthetic heavy chain variable domain

SEQ ID NO: 3676 - protein, 125 aa, Artificial Sequence; identical to SEQ ID NO: 218
  Description of Artificial Sequence: Synthetic heavy chain variable domain

SEQ ID NO: 3677 - protein, 125 aa, Artificial Sequence; identical to SEQ ID NO: 219
  Description of Artificial Sequence: Synthetic heavy chain variable domain

SEQ ID NO: 3678 - protein, 125 aa, Artificial Sequence; identical to SEQ ID NO: 220
  Description of Artificial Sequence: Synthetic heavy chain variable domain

SEQ ID NO: 3679 - protein, 125 aa, Artificial Sequence; identical to SEQ ID NO: 221
  Description of Artificial Sequence: Synthetic heavy chain variable domain

SEQ ID NO: 3680 - protein, 464 aa, Artificial Sequence; identical to SEQ ID NO: 207
  Description of Artificial Sequence: Synthetic heavy chain variable domain

SEQ ID NO: 3681 - protein, 120 aa, Artificial Sequence; identical to SEQ ID NO: 205
  Description of Artificial Sequence: Synthetic heavy chain variable domain

SEQ ID NO: 3682 - protein, 218 aa, Artificial Sequence; identical to SEQ ID NO: 224
  Description of Artificial Sequence: Synthetic heavy chain variable domain

SEQ ID NO: 3683 - protein, 219 aa, Artificial Sequence; identical to SEQ ID NO: 225
  Description of Artificial Sequence: Synthetic heavy chain variable domain

SEQ ID NO: 3684 - protein, 460 aa, Artificial Sequence; identical to SEQ ID NO: 202
  Description of Artificial Sequence: Synthetic heavy chain variable domain

SEQ ID NO: 3685 - protein, 242 aa, Artificial Sequence; identical to SEQ ID NO: 227
  Description of Artificial Sequence: Synthetic heavy chain variable domain

SEQ ID NO: 3686 - protein, 471 aa, Artificial Sequence; identical to SEQ ID NO: 204
  Description of Artificial Sequence: Synthetic heavy chain variable domain

SEQ ID NO: 3687 - protein, 118 aa, Artificial Sequence; identical to SEQ ID NO: 229
  Description of Artificial Sequence: Synthetic heavy chain variable domain

SEQ ID NO: 3688 - protein, 119 aa, Artificial Sequence; identical to SEQ ID NO: 230
  Description of Artificial Sequence: Synthetic heavy chain variable domain

SEQ ID NO: 3689 - protein, 112 aa, Artificial Sequence; identical to SEQ ID NO: 231
  Description of Artificial Sequence: Synthetic light chain variable domain

SEQ ID NO: 3690 - protein, 447 aa, Artificial Sequence; identical to SEQ ID NO: 232
  Description of Artificial Sequence: Synthetic light chain variable domain

SEQ ID NO: 3691 - protein, 111 aa, Artificial Sequence; identical to SEQ ID NO: 233
  Description of Artificial Sequence: Synthetic light chain variable domain

SEQ ID NO: 3692 - protein, 107 aa, Artificial Sequence; identical to SEQ ID NO: 234
  Description of Artificial Sequence: Synthetic light chain variable domain

SEQ ID NO: 3693 - protein, 214 aa, Artificial Sequence; identical to SEQ ID NO: 235
  Description of Artificial Sequence: Synthetic light chain variable domain

SEQ ID NO: 3694 - protein, 237 aa, Artificial Sequence; identical to SEQ ID NO: 236
  Description of Artificial Sequence: Synthetic light chain variable domain

SEQ ID NO: 3695 - protein, 107 aa, Artificial Sequence; identical to SEQ ID NO: 237
  Description of Artificial Sequence: Synthetic light chain variable domain

SEQ ID NO: 3696 - protein, 107 aa, Artificial Sequence; identical to SEQ ID NO: 237
  Description of Artificial Sequence: Synthetic light chain variable domain

SEQ ID NO: 3697 - protein, 115 aa, Artificial Sequence; identical to SEQ ID NO: 239
  Description of Artificial Sequence: Synthetic light chain variable domain

SEQ ID NO: 3698 - protein, 107 aa, Artificial Sequence; identical to SEQ ID NO: 237
  Description of Artificial Sequence: Synthetic light chain variable domain

SEQ ID NO: 3699 - protein, 112 aa, Artificial Sequence; identical to SEQ ID NO: 241
  Description of Artificial Sequence: Synthetic light chain variable domain

SEQ ID NO: 3700 - protein, 106 aa, Artificial Sequence; identical to SEQ ID NO: 242
  Description of Artificial Sequence: Synthetic light chain variable domain

SEQ ID NO: 3701 - protein, 106 aa, Artificial Sequence; identical to SEQ ID NO: 243
  Description of Artificial Sequence: Synthetic light chain variable domain

SEQ ID NO: 3702 - protein, 110 aa, Artificial Sequence; identical to SEQ ID NO: 244
  Description of Artificial Sequence: Synthetic light chain variable domain

SEQ ID NO: 3703 - protein, 109 aa, Artificial Sequence; identical to SEQ ID NO: 245
  Description of Artificial Sequence: Synthetic light chain variable domain

SEQ ID NO: 3704 - protein, 108 aa, Artificial Sequence; identical to SEQ ID NO: 246
  Description of Artificial Sequence: Synthetic light chain variable domain

SEQ ID NO: 3705 - protein, 107 aa, Artificial Sequence; identical to SEQ ID NO: 247
  Description of Artificial Sequence: Synthetic light chain variable domain

SEQ ID NO: 3706 - protein, 109 aa, Artificial Sequence; identical to SEQ ID NO: 248
  Description of Artificial Sequence: Synthetic light chain variable domain

SEQ ID NO: 3707 - protein, 109 aa, Artificial Sequence; identical to SEQ ID NO: 249
  Description of Artificial Sequence: Synthetic light chain variable domain

SEQ ID NO: 3708 - protein, 111 aa, Artificial Sequence; identical to SEQ ID NO: 250
  Description of Artificial Sequence: Synthetic light chain variable domain

SEQ ID NO: 3709 - protein, 109 aa, Artificial Sequence; identical to SEQ ID NO: 251
  Description of Artificial Sequence: Synthetic light chain variable domain
  MOD_RES (5)..(6): Any amino acid
  MOD_RES (8)..(9): Any amino acid
  MOD_RES (93)..(93): Any amino acid
  MOD_RES (104)..(104): Any amino acid

SEQ ID NO: 3710 - protein, 112 aa, Artificial Sequence; identical to SEQ ID NO: 252
  Description of Artificial Sequence: Synthetic light chain variable domain
  MOD_RES (61)..(61): Any amino acid

SEQ ID NO: 3711 - protein, 112 aa, Artificial Sequence; identical to SEQ ID NO: 253
  Description of Artificial Sequence: Synthetic light chain variable domain

SEQ ID NO: 3712 - protein, 110 aa, Artificial Sequence; identical to SEQ ID NO: 254
  Description of Artificial Sequence: Synthetic light chain variable domain

SEQ ID NO: 3713 - protein, 112 aa, Artificial Sequence; identical to SEQ ID NO: 255
  Description of Artificial Sequence: Synthetic light chain variable domain

SEQ ID NO: 3714 - protein, 111 aa, Artificial Sequence; identical to SEQ ID NO: 256
  Description of Artificial Sequence: Synthetic light chain variable domain

SEQ ID NO: 3715 - protein, 111 aa, Artificial Sequence; identical to SEQ ID NO: 257
  Description of Artificial Sequence: Synthetic light chain variable domain

SEQ ID NO: 3716 - protein, 106 aa, Artificial Sequence; identical to SEQ ID NO: 258
  Description of Artificial Sequence: Synthetic light chain variable domain

SEQ ID NO: 3717 - protein, 99 aa, Artificial Sequence; identical to SEQ ID NO: 259
  Description of Artificial Sequence: Synthetic light chain variable domain

SEQ ID NO: 3718 - protein, 110 aa, Artificial Sequence; identical to SEQ ID NO: 260
  Description of Artificial Sequence: Synthetic light chain variable domain

SEQ ID NO: 3719 - protein, 111 aa, Artificial Sequence; identical to SEQ ID NO: 261
  Description of Artificial Sequence: Synthetic light chain variable domain

SEQ ID NO: 3720 - protein, 124 aa, Artificial Sequence; identical to SEQ ID NO: 262
  Description of Artificial Sequence: Synthetic light chain variable domain

SEQ ID NO: 3721 - protein, 239 aa, Artificial Sequence; identical to SEQ ID NO: 263
  Description of Artificial Sequence: Synthetic light chain variable domain

SEQ ID NO: 3722 - protein, 111 aa, Artificial Sequence; identical to SEQ ID NO: 264
  Description of Artificial Sequence: Synthetic light chain variable domain

SEQ ID NO: 3723 - protein, 110 aa, Artificial Sequence; identical to SEQ ID NO: 265
  Description of Artificial Sequence: Synthetic light chain variable domain

SEQ ID NO: 3724 - protein, 111 aa, Artificial Sequence; identical to SEQ ID NO: 266
  Description of Artificial Sequence: Synthetic light chain variable domain

SEQ ID NO: 3725 - protein, 109 aa, Artificial Sequence; identical to SEQ ID NO: 267
  Description of Artificial Sequence: Synthetic light chain variable domain

SEQ ID NO: 3726 - protein, 108 aa, Artificial Sequence; identical to SEQ ID NO: 268
  Description of Artificial Sequence: Synthetic light chain variable domain

SEQ ID NO: 3727 - protein, 107 aa, Artificial Sequence; identical to SEQ ID NO: 269
  Description of Artificial Sequence: Synthetic light chain variable domain

SEQ ID NO: 3728 - protein, 109 aa, Artificial Sequence; identical to SEQ ID NO: 270
  Description of Artificial Sequence: Synthetic light chain variable domain

SEQ ID NO: 3729 - protein, 111 aa, Artificial Sequence; identical to SEQ ID NO: 271
  Description of Artificial Sequence: Synthetic light chain variable domain

SEQ ID NO: 3730 - protein, 121 aa, Artificial Sequence; identical to SEQ ID NO: 272
  Description of Artificial Sequence: Synthetic light chain variable domain

SEQ ID NO: 3731 - protein, 263 aa, Artificial Sequence; identical to SEQ ID NO: 273
  Description of Artificial Sequence: Synthetic single chain variable fragment

SEQ ID NO: 3732 - protein, 247 aa, Artificial Sequence; identical to SEQ ID NO: 274
  Description of Artificial Sequence: Synthetic single chain variable fragment

SEQ ID NO: 3733 - protein, 242 aa, Artificial Sequence; identical to SEQ ID NO: 275
  Description of Artificial Sequence: Synthetic single chain variable fragment

SEQ ID NO: 3734 - protein, 247 aa, Artificial Sequence; identical to SEQ ID NO: 276
  Description of Artificial Sequence: Synthetic single chain variable fragment

SEQ ID NO: 3735 - protein, 248 aa, Artificial Sequence; identical to SEQ ID NO: 277
  Description of Artificial Sequence: Synthetic single chain variable fragment

SEQ ID NO: 3736 - protein, 242 aa, Artificial Sequence; identical to SEQ ID NO: 278
  Description of Artificial Sequence: Synthetic single chain variable fragment

SEQ ID NO: 3737 - protein, 242 aa, Artificial Sequence; identical to SEQ ID NO: 279
  Description of Artificial Sequence: Synthetic single chain variable fragment

SEQ ID NO: 3738 - protein, 242 aa, Artificial Sequence; identical to SEQ ID NO: 280
  Description of Artificial Sequence: Synthetic single chain variable fragment

SEQ ID NO: 3739 - protein, 246 aa, Artificial Sequence; identical to SEQ ID NO: 281
  Description of Artificial Sequence: Synthetic single chain variable fragment

SEQ ID NO: 3740 - protein, 252 aa, Artificial Sequence; identical to SEQ ID NO: 282
  Description of Artificial Sequence: Synthetic single chain variable fragment

SEQ ID NO: 3741 - protein, 249 aa, Artificial Sequence; identical to SEQ ID NO: 283
  Description of Artificial Sequence: Synthetic single chain variable fragment

SEQ ID NO: 3742 - protein, 249 aa, Artificial Sequence; identical to SEQ ID NO: 284
  Description of Artificial Sequence: Synthetic single chain variable fragment

SEQ ID NO: 3743 - protein, 251 aa, Artificial Sequence; identical to SEQ ID NO: 285
  Description of Artificial Sequence: Synthetic single chain variable fragment

SEQ ID NO: 3744 - protein, 252 aa, Artificial Sequence; identical to SEQ ID NO: 286
  Description of Artificial Sequence: Synthetic single chain variable fragment

SEQ ID NO: 3745 - protein, 252 aa, Artificial Sequence; identical to SEQ ID NO: 286
  Description of Artificial Sequence: Synthetic single chain variable fragment

SEQ ID NO: 3746 - protein, 252 aa, Artificial Sequence; identical to SEQ ID NO: 288
  Description of Artificial Sequence: Synthetic single chain variable fragment

SEQ ID NO: 3747 - protein, 252 aa, Artificial Sequence; identical to SEQ ID NO: 288
  Description of Artificial Sequence: Synthetic single chain variable fragment

SEQ ID NO: 3748 - protein, 252 aa, Artificial Sequence; identical to SEQ ID NO: 288
  Description of Artificial Sequence: Synthetic single chain variable fragment

SEQ ID NO: 3749 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 3750 - protein, 252 aa, Artificial Sequence; identical to SEQ ID NO: 286
  Description of Artificial Sequence: Synthetic single chain variable fragment

SEQ ID NO: 3751 - protein, 250 aa, Artificial Sequence; identical to SEQ ID NO: 293
  Description of Artificial Sequence: Synthetic single chain variable fragment

SEQ ID NO: 3752 - protein, 252 aa, Artificial Sequence; identical to SEQ ID NO: 294
  Description of Artificial Sequence: Synthetic single chain variable fragment

SEQ ID NO: 3753 - protein, 236 aa, Artificial Sequence; identical to SEQ ID NO: 295
  Description of Artificial Sequence: Synthetic single chain variable fragment

SEQ ID NO: 3754 - protein, 251 aa, Artificial Sequence; identical to SEQ ID NO: 296
  Description of Artificial Sequence: Synthetic single chain variable fragment

SEQ ID NO: 3755 - protein, 246 aa, Artificial Sequence; identical to SEQ ID NO: 297
  Description of Artificial Sequence: Synthetic single chain variable fragment

SEQ ID NO: 3756 - protein, 239 aa, Artificial Sequence; identical to SEQ ID NO: 298
  Description of Artificial Sequence: Synthetic single chain variable fragment

SEQ ID NO: 3757 - protein, 250 aa, Artificial Sequence; identical to SEQ ID NO: 299
  Description of Artificial Sequence: Synthetic single chain variable fragment

SEQ ID NO: 3758 - protein, 251 aa, Artificial Sequence; identical to SEQ ID NO: 300
  Description of Artificial Sequence: Synthetic single chain variable fragment

SEQ ID NO: 3759 - protein, 242 aa, Artificial Sequence; identical to SEQ ID NO: 301
  Description of Artificial Sequence: Synthetic single chain variable fragment

SEQ ID NO: 3760 - protein, 242 aa, Artificial Sequence; identical to SEQ ID NO: 302
  Description of Artificial Sequence: Synthetic single chain variable fragment

SEQ ID NO: 3761 - protein, 246 aa, Artificial Sequence; identical to SEQ ID NO: 303
  Description of Artificial Sequence: Synthetic single chain variable fragment

SEQ ID NO: 3762 - protein, 249 aa, Artificial Sequence; identical to SEQ ID NO: 304
  Description of Artificial Sequence: Synthetic single chain variable fragment

SEQ ID NO: 3763 - protein, 249 aa, Artificial Sequence; identical to SEQ ID NO: 305
  Description of Artificial Sequence: Synthetic single chain variable fragment

SEQ ID NO: 3764 - protein, 252 aa, Artificial Sequence; identical to SEQ ID NO: 288
  Description of Artificial Sequence: Synthetic single chain variable fragment

SEQ ID NO: 3765 - protein, 495 aa, Artificial Sequence; identical to SEQ ID NO: 307
  Description of Artificial Sequence: Synthetic single chain variable fragment

SEQ ID NO: 3766 - protein, 247 aa, Artificial Sequence; identical to SEQ ID NO: 308
  Description of Artificial Sequence: Synthetic single chain variable fragment

SEQ ID NO: 3767 - protein, 251 aa, Artificial Sequence; identical to SEQ ID NO: 309
  Description of Artificial Sequence: Synthetic single chain variable fragment

SEQ ID NO: 3768 - protein, 250 aa, Artificial Sequence; identical to SEQ ID NO: 310
  Description of Artificial Sequence: Synthetic single chain variable fragment

SEQ ID NO: 3769 - protein, 247 aa, Artificial Sequence; identical to SEQ ID NO: 311
  Description of Artificial Sequence: Synthetic single chain variable fragment

SEQ ID NO: 3770 - protein, 248 aa, Artificial Sequence; identical to SEQ ID NO: 312
  Description of Artificial Sequence: Synthetic single chain variable fragment

SEQ ID NO: 3771 - protein, 242 aa, Artificial Sequence; identical to SEQ ID NO: 313
  Description of Artificial Sequence: Synthetic single chain variable fragment

SEQ ID NO: 3772 - protein, 251 aa, Artificial Sequence; identical to SEQ ID NO: 314
  Description of Artificial Sequence: Synthetic single chain variable fragment

SEQ ID NO: 3773 - protein, 247 aa, Artificial Sequence; identical to SEQ ID NO: 315
  Description of Artificial Sequence: Synthetic single chain variable fragment

SEQ ID NO: 3774 - protein, 250 aa, Artificial Sequence; identical to SEQ ID NO: 316
  Description of Artificial Sequence: Synthetic single chain variable fragment

SEQ ID NO: 3775 - protein, 252 aa, Artificial Sequence; identical to SEQ ID NO: 317
  Description of Artificial Sequence: Synthetic single chain variable fragment

SEQ ID NO: 3776 - protein, 247 aa, Artificial Sequence; identical to SEQ ID NO: 318
  Description of Artificial Sequence: Synthetic single chain variable fragment

SEQ ID NO: 3777 - protein, 247 aa, Artificial Sequence; identical to SEQ ID NO: 319
  Description of Artificial Sequence: Synthetic single chain variable fragment

SEQ ID NO: 3778 - protein, 249 aa, Artificial Sequence; identical to SEQ ID NO: 320
  Description of Artificial Sequence: Synthetic single chain variable fragment

SEQ ID NO: 3779 - protein, 251 aa, Artificial Sequence; identical to SEQ ID NO: 321
  Description of Artificial Sequence: Synthetic single chain variable fragment

SEQ ID NO: 3780 - protein, 247 aa, Artificial Sequence; identical to SEQ ID NO: 322
  Description of Artificial Sequence: Synthetic single chain variable fragment

SEQ ID NO: 3781 - protein, 241 aa, Artificial Sequence; identical to SEQ ID NO: 323
  Description of Artificial Sequence: Synthetic single chain variable fragment

SEQ ID NO: 3782 - protein, 248 aa, Artificial Sequence; identical to SEQ ID NO: 277
  Description of Artificial Sequence: Synthetic single chain variable fragment

SEQ ID NO: 3783 - protein, 246 aa, Artificial Sequence; identical to SEQ ID NO: 281
  Description of Artificial Sequence: Synthetic single chain variable fragment

SEQ ID NO: 3784 - protein, 252 aa, Artificial Sequence; identical to SEQ ID NO: 282
  Description of Artificial Sequence: Synthetic single chain variable fragment

SEQ ID NO: 3785 - protein, 249 aa, Artificial Sequence; identical to SEQ ID NO: 283
  Description of Artificial Sequence: Synthetic single chain variable fragment

SEQ ID NO: 3786 - protein, 249 aa, Artificial Sequence; identical to SEQ ID NO: 284
  Description of Artificial Sequence: Synthetic single chain variable fragment

SEQ ID NO: 3787 - protein, 251 aa, Artificial Sequence; identical to SEQ ID NO: 285
  Description of Artificial Sequence: Synthetic single chain variable fragment

SEQ ID NO: 3788 - protein, 252 aa, Artificial Sequence; identical to SEQ ID NO: 286
  Description of Artificial Sequence: Synthetic single chain variable fragment

SEQ ID NO: 3789 - protein, 252 aa, Artificial Sequence; identical to SEQ ID NO: 286
  Description of Artificial Sequence: Synthetic single chain variable fragment

SEQ ID NO: 3790 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 3791 - protein, 252 aa, Artificial Sequence; identical to SEQ ID NO: 288
  Description of Artificial Sequence: Synthetic single chain variable fragment

SEQ ID NO: 3792 - protein, 252 aa, Artificial Sequence; identical to SEQ ID NO: 288
  Description of Artificial Sequence: Synthetic single chain variable fragment

SEQ ID NO: 3793 - protein, 252 aa, Artificial Sequence; identical to SEQ ID NO: 288
  Description of Artificial Sequence: Synthetic single chain variable fragment

SEQ ID NO: 3794 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 3795 - protein, 252 aa, Artificial Sequence; identical to SEQ ID NO: 286
  Description of Artificial Sequence: Synthetic single chain variable fragment

SEQ ID NO: 3796 - protein, 250 aa, Artificial Sequence; identical to SEQ ID NO: 293
  Description of Artificial Sequence: Synthetic single chain variable fragment

SEQ ID NO: 3797 - protein, 252 aa, Artificial Sequence; identical to SEQ ID NO: 294
  Description of Artificial Sequence: Synthetic single chain variable fragment

SEQ ID NO: 3798 - protein, 236 aa, Artificial Sequence; identical to SEQ ID NO: 295
  Description of Artificial Sequence: Synthetic single chain variable fragment

SEQ ID NO: 3799 - protein, 251 aa, Artificial Sequence; identical to SEQ ID NO: 296
  Description of Artificial Sequence: Synthetic single chain variable fragment

SEQ ID NO: 3800 - protein, 246 aa, Artificial Sequence; identical to SEQ ID NO: 297
  Description of Artificial Sequence: Synthetic single chain variable fragment

SEQ ID NO: 3801 - protein, 239 aa, Artificial Sequence; identical to SEQ ID NO: 298
  Description of Artificial Sequence: Synthetic single chain variable fragment

SEQ ID NO: 3802 - protein, 250 aa, Artificial Sequence; identical to SEQ ID NO: 299
  Description of Artificial Sequence: Synthetic single chain variable fragment

SEQ ID NO: 3803 - protein, 251 aa, Artificial Sequence; identical to SEQ ID NO: 300
  Description of Artificial Sequence: Synthetic single chain variable fragment

SEQ ID NO: 3804 - protein, 273 aa, Artificial Sequence; identical to SEQ ID NO: 346
  Description of Artificial Sequence: Synthetic single chain variable fragment

SEQ ID NO: 3805 - protein, 270 aa, Artificial Sequence; identical to SEQ ID NO: 347
  Description of Artificial Sequence: Synthetic single chain variable fragment

SEQ ID NO: 3806 - protein, 277 aa, Artificial Sequence; identical to SEQ ID NO: 348
  Description of Artificial Sequence: Synthetic single chain variable fragment

SEQ ID NO: 3807 - protein, 246 aa, Artificial Sequence; identical to SEQ ID NO: 303
  Description of Artificial Sequence: Synthetic single chain variable fragment

SEQ ID NO: 3808 - protein, 249 aa, Artificial Sequence; identical to SEQ ID NO: 304
  Description of Artificial Sequence: Synthetic single chain variable fragment

SEQ ID NO: 3809 - protein, 249 aa, Artificial Sequence; identical to SEQ ID NO: 305
  Description of Artificial Sequence: Synthetic single chain variable fragment

SEQ ID NO: 3810 - protein, 252 aa, Artificial Sequence; identical to SEQ ID NO: 288
  Description of Artificial Sequence: Synthetic single chain variable fragment

SEQ ID NO: 3811 - protein, 251 aa, Artificial Sequence; identical to SEQ ID NO: 309
  Description of Artificial Sequence: Synthetic single chain variable fragment

SEQ ID NO: 3812 - protein, 250 aa, Artificial Sequence; identical to SEQ ID NO: 310
  Description of Artificial Sequence: Synthetic single chain variable fragment

SEQ ID NO: 3813 - protein, 247 aa, Artificial Sequence; identical to SEQ ID NO: 311
  Description of Artificial Sequence: Synthetic single chain variable fragment

SEQ ID NO: 3814 - protein, 248 aa, Artificial Sequence; identical to SEQ ID NO: 312
  Description of Artificial Sequence: Synthetic single chain variable fragment

SEQ ID NO: 3815 - protein, 251 aa, Artificial Sequence; identical to SEQ ID NO: 314
  Description of Artificial Sequence: Synthetic single chain variable fragment

SEQ ID NO: 3816 - protein, 250 aa, Artificial Sequence; identical to SEQ ID NO: 316
  Description of Artificial Sequence: Synthetic single chain variable fragment

SEQ ID NO: 3817 - protein, 249 aa, Artificial Sequence; identical to SEQ ID NO: 320
  Description of Artificial Sequence: Synthetic single chain variable fragment

SEQ ID NO: 3818 - protein, 251 aa, Artificial Sequence; identical to SEQ ID NO: 321
  Description of Artificial Sequence: Synthetic single chain variable fragment

SEQ ID NO: 3819 - protein, 249 aa, Artificial Sequence; identical to SEQ ID NO: 284
  Description of Artificial Sequence: Synthetic single chain variable fragment

SEQ ID NO: 3820 - protein, 242 aa, Artificial Sequence; identical to SEQ ID NO: 275
  Description of Artificial Sequence: Synthetic single chain variable fragment

SEQ ID NO: 3821 - protein, 245 aa, Artificial Sequence; identical to SEQ ID NO: 363
  Description of Artificial Sequence: Synthetic single chain variable fragment

SEQ ID NO: 3822 - protein, 119 aa, Artificial Sequence; identical to SEQ ID NO: 364
  Description of Artificial Sequence: Synthetic single chain variable fragment

SEQ ID NO: 3823 - protein, 438 aa, Artificial Sequence; identical to SEQ ID NO: 365
  Description of Artificial Sequence: Synthetic single chain variable fragment

SEQ ID NO: 3824 - protein, 272 aa, Artificial Sequence; identical to SEQ ID NO: 366
  Description of Artificial Sequence: Synthetic single chain variable fragment

SEQ ID NO: 3825 - protein, 267 aa, Artificial Sequence; identical to SEQ ID NO: 367
  Description of Artificial Sequence: Synthetic single chain variable fragment

SEQ ID NO: 3826 - protein, 270 aa, Artificial Sequence; identical to SEQ ID NO: 347
  Description of Artificial Sequence: Synthetic single chain variable fragment

SEQ ID NO: 3827 - protein, 277 aa, Artificial Sequence; identical to SEQ ID NO: 348
  Description of Artificial Sequence: Synthetic single chain variable fragment

SEQ ID NO: 3828 - protein, 242 aa, Artificial Sequence; identical to SEQ ID NO: 280
  Description of Artificial Sequence: Synthetic single chain variable fragment

SEQ ID NO: 3829 - protein, 242 aa, Artificial Sequence; identical to SEQ ID NO: 301
  Description of Artificial Sequence: Synthetic single chain variable fragment

SEQ ID NO: 3830 - protein, 242 aa, Artificial Sequence; identical to SEQ ID NO: 302
  Description of Artificial Sequence: Synthetic single chain variable fragment

SEQ ID NO: 3831 - protein, 247 aa, Artificial Sequence; identical to SEQ ID NO: 308
  Description of Artificial Sequence: Synthetic single chain variable fragment

SEQ ID NO: 3832 - protein, 247 aa, Artificial Sequence; identical to SEQ ID NO: 315
  Description of Artificial Sequence: Synthetic single chain variable fragment

SEQ ID NO: 3833 - protein, 247 aa, Artificial Sequence; identical to SEQ ID NO: 318
  Description of Artificial Sequence: Synthetic single chain variable fragment

SEQ ID NO: 3834 - protein, 247 aa, Artificial Sequence; identical to SEQ ID NO: 319
  Description of Artificial Sequence: Synthetic single chain variable fragment

SEQ ID NO: 3835 - protein, 247 aa, Artificial Sequence; identical to SEQ ID NO: 322
  Description of Artificial Sequence: Synthetic single chain variable fragment

SEQ ID NO: 3836 - protein, 247 aa, Artificial Sequence; identical to SEQ ID NO: 276
  Description of Artificial Sequence: Synthetic single chain variable fragment

SEQ ID NO: 3837 - protein, 242 aa, Artificial Sequence; identical to SEQ ID NO: 278
  Description of Artificial Sequence: Synthetic single chain variable fragment

SEQ ID NO: 3838 - protein, 495 aa, Artificial Sequence; identical to SEQ ID NO: 307
  Description of Artificial Sequence: Synthetic single chain variable fragment

SEQ ID NO: 3839 - protein, 242 aa, Artificial Sequence; identical to SEQ ID NO: 279
  Description of Artificial Sequence: Synthetic single chain variable fragment

SEQ ID NO: 3840 - protein, 242 aa, Artificial Sequence; identical to SEQ ID NO: 313
  Description of Artificial Sequence: Synthetic single chain variable fragment

SEQ ID NO: 3841 - protein, 252 aa, Artificial Sequence; identical to SEQ ID NO: 317
  Description of Artificial Sequence: Synthetic single chain variable fragment

SEQ ID NO: 3842 - protein, 250 aa, Artificial Sequence; identical to SEQ ID NO: 384
  Description of Artificial Sequence: Synthetic single chain variable fragment

SEQ ID NO: 3843 - protein, 242 aa, Artificial Sequence; identical to SEQ ID NO: 313
  Description of Artificial Sequence: Synthetic single chain variable fragment

SEQ ID NO: 3844 - protein, 251 aa, Artificial Sequence; identical to SEQ ID NO: 386
  Description of Artificial Sequence: Synthetic single chain variable fragment

SEQ ID NO: 3845 - protein, 271 aa, Artificial Sequence; identical to SEQ ID NO: 387
  Description of Artificial Sequence: Synthetic single chain variable fragment

SEQ ID NO: 3846 - protein, 248 aa, Artificial Sequence; identical to SEQ ID NO: 277
  Description of Artificial Sequence: Synthetic single chain variable fragment

SEQ ID NO: 3847 - protein, 246 aa, Artificial Sequence; identical to SEQ ID NO: 281
  Description of Artificial Sequence: Synthetic single chain variable fragment

SEQ ID NO: 3848 - protein, 252 aa, Artificial Sequence; identical to SEQ ID NO: 282
  Description of Artificial Sequence: Synthetic single chain variable fragment

SEQ ID NO: 3849 - protein, 249 aa, Artificial Sequence; identical to SEQ ID NO: 283
  Description of Artificial Sequence: Synthetic single chain variable fragment

SEQ ID NO: 3850 - protein, 251 aa, Artificial Sequence; identical to SEQ ID NO: 285
  Description of Artificial Sequence: Synthetic single chain variable fragment

SEQ ID NO: 3851 - protein, 252 aa, Artificial Sequence; identical to SEQ ID NO: 286
  Description of Artificial Sequence: Synthetic single chain variable fragment

SEQ ID NO: 3852 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 3853 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 3854 - protein, 250 aa, Artificial Sequence; identical to SEQ ID NO: 293
  Description of Artificial Sequence: Synthetic single chain variable fragment

SEQ ID NO: 3855 - protein, 252 aa, Artificial Sequence; identical to SEQ ID NO: 294
  Description of Artificial Sequence: Synthetic single chain variable fragment

SEQ ID NO: 3856 - protein, 236 aa, Artificial Sequence; identical to SEQ ID NO: 295
  Description of Artificial Sequence: Synthetic single chain variable fragment

SEQ ID NO: 3857 - protein, 251 aa, Artificial Sequence; identical to SEQ ID NO: 296
  Description of Artificial Sequence: Synthetic single chain variable fragment

SEQ ID NO: 3858 - protein, 246 aa, Artificial Sequence; identical to SEQ ID NO: 297
  Description of Artificial Sequence: Synthetic single chain variable fragment

SEQ ID NO: 3859 - protein, 239 aa, Artificial Sequence; identical to SEQ ID NO: 298
  Description of Artificial Sequence: Synthetic single chain variable fragment

SEQ ID NO: 3860 - protein, 250 aa, Artificial Sequence; identical to SEQ ID NO: 299
  Description of Artificial Sequence: Synthetic single chain variable fragment

SEQ ID NO: 3861 - protein, 251 aa, Artificial Sequence; identical to SEQ ID NO: 300
  Description of Artificial Sequence: Synthetic single chain variable fragment

SEQ ID NO: 3862 - protein, 246 aa, Artificial Sequence; identical to SEQ ID NO: 303
  Description of Artificial Sequence: Synthetic single chain variable fragment

SEQ ID NO: 3863 - protein, 249 aa, Artificial Sequence; identical to SEQ ID NO: 304
  Description of Artificial Sequence: Synthetic single chain variable fragment

SEQ ID NO: 3864 - protein, 249 aa, Artificial Sequence; identical to SEQ ID NO: 305
  Description of Artificial Sequence: Synthetic single chain variable fragment

SEQ ID NO: 3865 - protein, 252 aa, Artificial Sequence; identical to SEQ ID NO: 288
  Description of Artificial Sequence: Synthetic single chain variable fragment

SEQ ID NO: 3866 - protein, 251 aa, Artificial Sequence; identical to SEQ ID NO: 309
  Description of Artificial Sequence: Synthetic single chain variable fragment

SEQ ID NO: 3867 - protein, 250 aa, Artificial Sequence; identical to SEQ ID NO: 310
  Description of Artificial Sequence: Synthetic single chain variable fragment

SEQ ID NO: 3868 - protein, 247 aa, Artificial Sequence; identical to SEQ ID NO: 311
  Description of Artificial Sequence: Synthetic single chain variable fragment

SEQ ID NO: 3869 - protein, 248 aa, Artificial Sequence; identical to SEQ ID NO: 312
  Description of Artificial Sequence: Synthetic single chain variable fragment

SEQ ID NO: 3870 - protein, 251 aa, Artificial Sequence; identical to SEQ ID NO: 314
  Description of Artificial Sequence: Synthetic single chain variable fragment

SEQ ID NO: 3871 - protein, 250 aa, Artificial Sequence; identical to SEQ ID NO: 316
  Description of Artificial Sequence: Synthetic single chain variable fragment

SEQ ID NO: 3872 - protein, 249 aa, Artificial Sequence; identical to SEQ ID NO: 320
  Description of Artificial Sequence: Synthetic single chain variable fragment

SEQ ID NO: 3873 - protein, 251 aa, Artificial Sequence; identical to SEQ ID NO: 321
  Description of Artificial Sequence: Synthetic single chain variable fragment

SEQ ID NO: 3874 - protein, 249 aa, Artificial Sequence; identical to SEQ ID NO: 284
  Description of Artificial Sequence: Synthetic single chain variable fragment

SEQ ID NO: 3875 - protein, 277 aa, Artificial Sequence; identical to SEQ ID NO: 417
  Description of Artificial Sequence: Synthetic single chain variable fragment

SEQ ID NO: 3876 - protein, 242 aa, Artificial Sequence; identical to SEQ ID NO: 313
  Description of Artificial Sequence: Synthetic CD19 scFv

SEQ ID NO: 3877 - protein, 486 aa, Artificial Sequence; identical to SEQ ID NO: 669
  Description of Artificial Sequence: Synthetic Construct

SEQ ID NO: 3878 - protein, 593 aa, Artificial Sequence; identical to SEQ ID NO: 670
  Description of Artificial Sequence: Synthetic Construct

SEQ ID NO: 3879 - protein, 644 aa, Artificial Sequence; identical to SEQ ID NO: 671
  Description of Artificial Sequence: Synthetic Construct

SEQ ID NO: 3880 - protein, 593 aa, Artificial Sequence; identical to SEQ ID NO: 672
  Description of Artificial Sequence: Synthetic Construct

SEQ ID NO: 3881 - protein, 644 aa, Artificial Sequence; identical to SEQ ID NO: 673
  Description of Artificial Sequence: Synthetic Construct

SEQ ID NO: 3882 - protein, 649 aa, Artificial Sequence; identical to SEQ ID NO: 674
  Description of Artificial Sequence: Synthetic Construct

SEQ ID NO: 3883 - protein, 598 aa, Artificial Sequence; identical to SEQ ID NO: 675
  Description of Artificial Sequence: Synthetic Construct

SEQ ID NO: 3884 - protein, 677 aa, Artificial Sequence; identical to SEQ ID NO: 676
  Description of Artificial Sequence: Synthetic Construct

SEQ ID NO: 3885 - protein, 677 aa, Artificial Sequence; identical to SEQ ID NO: 677
  Description of Artificial Sequence: Synthetic Construct

SEQ ID NO: 3886 - protein, 677 aa, Artificial Sequence; identical to SEQ ID NO: 678
  Description of Artificial Sequence: Synthetic Construct

SEQ ID NO: 3887 - protein, 677 aa, Artificial Sequence; identical to SEQ ID NO: 679
  Description of Artificial Sequence: Synthetic Construct

SEQ ID NO: 3888 - protein, 607 aa, Artificial Sequence; identical to SEQ ID NO: 680
  Description of Artificial Sequence: Synthetic Construct

SEQ ID NO: 3889 - protein, 658 aa, Artificial Sequence; identical to SEQ ID NO: 681
  Description of Artificial Sequence: Synthetic Construct

SEQ ID NO: 3890 - protein, 686 aa, Artificial Sequence; identical to SEQ ID NO: 682
  Description of Artificial Sequence: Synthetic Construct

SEQ ID NO: 3891 - protein, 686 aa, Artificial Sequence; identical to SEQ ID NO: 683
  Description of Artificial Sequence: Synthetic Construct

SEQ ID NO: 3892 - protein, 677 aa, Artificial Sequence; identical to SEQ ID NO: 676
  Description of Artificial Sequence: Synthetic polypeptide

SEQ ID NO: 3893 - protein, 488 aa, Artificial Sequence; identical to SEQ ID NO: 685
  Description of Artificial Sequence: Synthetic polypeptide

SEQ ID NO: 3894 - protein, 508 aa, Artificial Sequence; identical to SEQ ID NO: 686
  Description of Artificial Sequence: Synthetic polypeptide

SEQ ID NO: 3895 - protein, 497 aa, Artificial Sequence; identical to SEQ ID NO: 687
  Description of Artificial Sequence: Synthetic polypeptide

SEQ ID NO: 3896 - protein, 502 aa, Artificial Sequence; identical to SEQ ID NO: 688
  Description of Artificial Sequence: Synthetic polypeptide

SEQ ID NO: 3897 - protein, 486 aa, Artificial Sequence; identical to SEQ ID NO: 669
  Description of Artificial Sequence: Synthetic polypeptide

SEQ ID NO: 3898 - protein, 743 aa, Artificial Sequence; identical to SEQ ID NO: 690
  Description of Artificial Sequence: Synthetic polypeptide

SEQ ID NO: 3899 - protein, 885 aa, Artificial Sequence; identical to SEQ ID NO: 691
  Description of Artificial Sequence: Synthetic polypeptide

SEQ ID NO: 3900 - protein, 907 aa, Artificial Sequence; identical to SEQ ID NO: 692
  Description of Artificial Sequence: Synthetic polypeptide

SEQ ID NO: 3901 - protein, 903 aa, Artificial Sequence; identical to SEQ ID NO: 693
  Description of Artificial Sequence: Synthetic polypeptide

SEQ ID NO: 3902 - protein, 604 aa, Artificial Sequence; identical to SEQ ID NO: 694
  Description of Artificial Sequence: Synthetic polypeptide

SEQ ID NO: 3903 - protein, 9 aa, Artificial Sequence
  Description of Artificial Sequence: Synthetic peptide
MHRSAAAAT

SEQ ID NO: 3904 - protein, 12 aa, Artificial Sequence
  Description of Artificial Sequence: Synthetic peptide
IPPPPPLSLPPP

SEQ ID NO: 3905 - protein, 43 aa, Artificial Sequence; identical to SEQ ID NO: 697
  Description of Artificial Sequence: Synthetic polypeptide

SEQ ID NO: 3906 - protein, 102 aa, Artificial Sequence; identical to SEQ ID NO: 698
  Description of Artificial Sequence: Synthetic polypeptide

SEQ ID NO: 3907 - protein, 41 aa, Artificial Sequence; identical to SEQ ID NO: 699
  Description of Artificial Sequence: Synthetic polypeptide

SEQ ID NO: 3908 - protein, 24 aa, Artificial Sequence
  Description of Artificial Sequence: Synthetic peptide
ARARRITWPSSRSSCASRCTWRAP

SEQ ID NO: 3909 - protein, 23 aa, Artificial Sequence
  Description of Artificial Sequence: Synthetic peptide
TATSSRSRARARAAPTRAPRPPS

SEQ ID NO: 3910 - protein, 24 aa, Artificial Sequence
  Description of Artificial Sequence: Synthetic peptide
PRVAPCPSPGTSCPLSSCTAPRPT

SEQ ID NO: 3911 - protein, 9 aa, Artificial Sequence
  Description of Artificial Sequence: Synthetic peptide
STPPTSPTT

SEQ ID NO: 3912 - protein, 12 aa, Artificial Sequence
  Description of Artificial Sequence: Synthetic peptide
SCPSPRASSGSA

SEQ ID NO: 3913 - protein, 7 aa, Artificial Sequence
  Description of Artificial Sequence: Synthetic peptide
TSRTAAW

SEQ ID NO: 3914 - protein, 14 aa, Artificial Sequence
  Description of Artificial Sequence: Synthetic peptide
PRTPPCRTASSSTR

SEQ ID NO: 3915 - protein, 12 aa, Artificial Sequence
  Description of Artificial Sequence: Synthetic peptide
SCAAPTSPPTAP

SEQ ID NO: 3916 - protein, 21 aa, Artificial Sequence
  Description of Artificial Sequence: Synthetic peptide
CRRRPWAGRPPPSGCTPRTAP

SEQ ID NO: 3917 - protein, 7 aa, Artificial Sequence
  Description of Artificial Sequence: Synthetic peptide
RARSSRG

SEQ ID NO: 3918 - protein, 64 aa, Artificial Sequence; identical to SEQ ID NO: 710
  Description of Artificial Sequence: Synthetic polypeptide

SEQ ID NO: 3919 - protein, 107 aa, Homo sapiens; identical to SEQ ID NO: 192

SEQ ID NO: 3920 - protein, 187 aa, Homo sapiens; identical to SEQ ID NO: 1

SEQ ID NO: 3921 - protein, 159 aa, Escherichia coli [sequence omitted]

SEQ ID NO: 3922 - protein, 327 aa, Homo sapiens; identical to SEQ ID NO: 195

SEQ ID NO: 3923 - protein, 189 aa, Homo sapiens; identical to SEQ ID NO: 196

SEQ ID NO: 3924 - protein, 260 aa, Homo sapiens; identical to SEQ ID NO: 197

SEQ ID NO: 3925 - protein, 231 aa, Homo sapiens; identical to SEQ ID NO: 198

SEQ ID NO: 3926 - protein, 114 aa, Homo sapiens; identical to SEQ ID NO: 718

SEQ ID NO: 3927 - protein, 267 aa, Homo sapiens; identical to SEQ ID NO: 719

SEQ ID NO: 3928 - protein, 234 aa, Homo sapiens; identical to SEQ ID NO: 720

SEQ ID NO: 3929 - protein, 231 aa, Homo sapiens; identical to SEQ ID NO: 721

SEQ ID NO: 3930 - protein, 353 aa, Homo sapiens; identical to SEQ ID NO: 722

SEQ ID NO: 3931 - protein, 61 aa, Homo sapiens; identical to SEQ ID NO: 723

SEQ ID NO: 3932 - protein, 237 aa, Homo sapiens; identical to SEQ ID NO: 724

SEQ ID NO: 3933 - protein, 175 aa, Homo sapiens; identical to SEQ ID NO: 725

SEQ ID NO: 3934 - protein, 65 aa, Homo sapiens; identical to SEQ ID NO: 726

SEQ ID NO: 3935 - protein, 107 aa, Homo sapiens; identical to SEQ ID NO: 192

SEQ ID NO: 3936 - protein, 187 aa, Homo sapiens; identical to SEQ ID NO: 1

SEQ ID NO: 3937 - protein, 159 aa, Escherichia coli [sequence omitted]

SEQ ID NO: 3938 - protein, 327 aa, Homo sapiens; identical to SEQ ID NO: 195

SEQ ID NO: 3939 - protein, 189 aa, Homo sapiens; identical to SEQ ID NO: 196

SEQ ID NO: 3940 - protein, 260 aa, Homo sapiens; identical to SEQ ID NO: 197

SEQ ID NO: 3941 - protein, 231 aa, Homo sapiens; identical to SEQ ID NO: 198

SEQ ID NO: 3942 - protein, 306 aa, Homo sapiens; identical to SEQ ID NO: 734

SEQ ID NO: 3943 - protein, 197 aa, Homo sapiens; identical to SEQ ID NO: 735

SEQ ID NO: 3944 - protein, 107 aa, Homo sapiens; identical to SEQ ID NO: 192

SEQ ID NO: 3945 - protein, 187 aa, Homo sapiens; identical to SEQ ID NO: 1

SEQ ID NO: 3946 - protein, 159 aa, Escherichia coli [sequence omitted]

SEQ ID NO: 3947 - protein, 327 aa, Homo sapiens; identical to SEQ ID NO: 195

SEQ ID NO: 3948 - protein, 189 aa, Homo sapiens; identical to SEQ ID NO: 196

SEQ ID NO: 3949 - protein, 260 aa, Homo sapiens; identical to SEQ ID NO: 197

SEQ ID NO: 3950 - protein, 231 aa, Homo sapiens; identical to SEQ ID NO: 198

SEQ ID NO: 3951 - protein, 133 aa, Homo sapiens [sequence omitted]

SEQ ID NO: 3952 - protein, 415 aa, Homo sapiens; identical to SEQ ID NO: 744

SEQ ID NO: 3953 - protein, 431 aa, Homo sapiens; identical to SEQ ID NO: 745

SEQ ID NO: 3954 - protein, 430 aa, Artificial Sequence; identical to SEQ ID NO: 746
  Description of Artificial Sequence: Synthetic Payload

SEQ ID NO: 3955 - protein, 396 aa, Homo sapiens; identical to SEQ ID NO: 747

SEQ ID NO: 3956 - protein, 395 aa, Artificial Sequence; identical to SEQ ID NO: 748
  Description of Artificial Sequence: Synthetic Payload

SEQ ID NO: 3957 - protein, 119 aa, Artificial Sequence; identical to SEQ ID NO: 749
  Description of Artificial Sequence: Synthetic Antibody variable domain

SEQ ID NO: 3958 - protein, 118 aa, Artificial Sequence; identical to SEQ ID NO: 750
  Description of Artificial Sequence: Synthetic Antibody variable domain

SEQ ID NO: 3959 - protein, 118 aa, Artificial Sequence; identical to SEQ ID NO: 750
  Description of Artificial Sequence: Synthetic Antibody variable domain

SEQ ID NO: 3960 - protein, 120 aa, Artificial Sequence; identical to SEQ ID NO: 752
  Description of Artificial Sequence: Synthetic Antibody variable domain

SEQ ID NO: 3961 - protein, 119 aa, Artificial Sequence; identical to SEQ ID NO: 753
  Description of Artificial Sequence: Synthetic Antibody variable domain

SEQ ID NO: 3962 - protein, 119 aa, Artificial Sequence; identical to SEQ ID NO: 754
  Description of Artificial Sequence: Synthetic Antibody variable domain

SEQ ID NO: 3963 - protein, 117 aa, Artificial Sequence; identical to SEQ ID NO: 755
  Description of Artificial Sequence: Synthetic Antibody variable domain

SEQ ID NO: 3964 - protein, 119 aa, Artificial Sequence; identical to SEQ ID NO: 756
  Description of Artificial Sequence: Synthetic Antibody variable domain

SEQ ID NO: 3965 - protein, 112 aa, Artificial Sequence; identical to SEQ ID NO: 757
  Description of Artificial Sequence: Synthetic Antibody variable domain

SEQ ID NO: 3966 - protein, 111 aa, Artificial Sequence; identical to SEQ ID NO: 758
  Description of Artificial Sequence: Synthetic Antibody variable domain

SEQ ID NO: 3967 - protein, 112 aa, Artificial Sequence; identical to SEQ ID NO: 759
  Description of Artificial Sequence: Synthetic Antibody variable domain

SEQ ID NO: 3968 - protein, 107 aa, Artificial Sequence; identical to SEQ ID NO: 760
  Description of Artificial Sequence: Synthetic Antibody variable domain

SEQ ID NO: 3969 - protein, 112 aa, Artificial Sequence; identical to SEQ ID NO: 761
  Description of Artificial Sequence: Synthetic Antibody variable domain

SEQ ID NO: 3970 - protein, 111 aa, Artificial Sequence; identical to SEQ ID NO: 762
  Description of Artificial Sequence: Synthetic Antibody variable domain

SEQ ID NO: 3971 - protein, 112 aa, Artificial Sequence; identical to SEQ ID NO: 763
  Description of Artificial Sequence: Synthetic Antibody variable domain

SEQ ID NO: 3972 - protein, 107 aa, Artificial Sequence; identical to SEQ ID NO: 764
  Description of Artificial Sequence: Synthetic Antibody variable domain

SEQ ID NO: 3973 - protein, 246 aa, Artificial Sequence; identical to SEQ ID NO: 765
  Description of Artificial Sequence: Synthetic scFv

SEQ ID NO: 3974 - protein, 246 aa, Artificial Sequence; identical to SEQ ID NO: 766
  Description of Artificial Sequence: Synthetic scFv

SEQ ID NO: 3975 - protein, 245 aa, Artificial Sequence; identical to SEQ ID NO: 767
  Description of Artificial Sequence: Synthetic scFv

SEQ ID NO: 3976 - protein, 242 aa, Artificial Sequence; identical to SEQ ID NO: 768
  Description of Artificial Sequence: Synthetic scFv

SEQ ID NO: 3977 - protein, 248 aa, Artificial Sequence; identical to SEQ ID NO: 769
  Description of Artificial Sequence: Synthetic scFv

SEQ ID NO: 3978 - protein, 247 aa, Artificial Sequence; identical to SEQ ID NO: 770
  Description of Artificial Sequence: Synthetic scFv

SEQ ID NO: 3979 - protein, 246 aa, Artificial Sequence; identical to SEQ ID NO: 771
  Description of Artificial Sequence: Synthetic scFv

SEQ ID NO: 3980 - protein, 243 aa, Artificial Sequence; identical to SEQ ID NO: 772
  Description of Artificial Sequence: Synthetic scFv

SEQ ID NO: 3981 - protein, 107 aa, Artificial Sequence; identical to SEQ ID NO: 773
  Description of Artificial Sequence: Synthetic Antibody variable domain

SEQ ID NO: 3982 - protein, 244 aa, Artificial Sequence; identical to SEQ ID NO: 789
  Description of Artificial Sequence: Synthetic scFv

SEQ ID NO: 3983 - protein, 244 aa, Artificial Sequence; identical to SEQ ID NO: 790
  Description of Artificial Sequence: Synthetic scFv

SEQ ID NO: 3984 - protein, 248 aa, Artificial Sequence; identical to SEQ ID NO: 791
  Description of Artificial Sequence: Synthetic scFv

SEQ ID NO: 3985 - protein, 120 aa, Mus musculus; identical to SEQ ID NO: 781

SEQ ID NO: 3986 - protein, 119 aa, Artificial Sequence; identical to SEQ ID NO: 782
  Description of Artificial Sequence: Synthetic Antibody variable domain

SEQ ID NO: 3987 - protein, 122 aa, Artificial Sequence; identical to SEQ ID NO: 783
  Description of Artificial Sequence: Synthetic Antibody variable domain

SEQ ID NO: 3988 - protein, 117 aa, Artificial Sequence; identical to SEQ ID NO: 784
  Description of Artificial Sequence: Synthetic Antibody variable domain

SEQ ID NO: 3989 - protein, 107 aa, Mus musculus; identical to SEQ ID NO: 785

SEQ ID NO: 3990 - protein, 109 aa, Artificial Sequence; identical to SEQ ID NO: 786
  Description of Artificial Sequence: Synthetic Antibody variable domain

SEQ ID NO: 3991 - protein, 110 aa, Artificial Sequence; identical to SEQ ID NO: 787
  Description of Artificial Sequence: Synthetic Antibody variable domain

SEQ ID NO: 3992 - protein, 109 aa, Artificial Sequence; identical to SEQ ID NO: 788
  Description of Artificial Sequence: Synthetic Antibody variable domain

SEQ ID NO: 3993 - protein, 244 aa, Artificial Sequence; identical to SEQ ID NO: 789
  Description of Artificial Sequence: Synthetic scFv

SEQ ID NO: 3994 - protein, 244 aa, Artificial Sequence; identical to SEQ ID NO: 790
  Description of Artificial Sequence: Synthetic scFv

SEQ ID NO: 3995 - protein, 248 aa, Artificial Sequence; identical to SEQ ID NO: 791
  Description of Artificial Sequence: Synthetic scFv

SEQ ID NO: 3996 - protein, 242 aa, Artificial Sequence; identical to SEQ ID NO: 792
  Description of Artificial Sequence: Synthetic scFv

SEQ ID NO: 3997 - protein, 449 aa, Artificial Sequence; identical to SEQ ID NO: 793
  Description of Artificial Sequence: Synthetic Antibody variable domain

SEQ ID NO: 3998 - protein, 211 aa, Artificial Sequence; identical to SEQ ID NO: 794
  Description of Artificial Sequence: Synthetic Antibody variable domain

SEQ ID NO: 3999 - protein, 446 aa, Artificial Sequence; identical to SEQ ID NO: 795
  Description of Artificial Sequence: Synthetic Antibody variable domain

SEQ ID NO: 4000 - protein, 448 aa, Artificial Sequence; identical to SEQ ID NO: 796
  Description of Artificial Sequence: Synthetic Antibody variable domain

SEQ ID NO: 4001 - protein, 211 aa, Artificial Sequence; identical to SEQ ID NO: 797
  Description of Artificial Sequence: Synthetic Antibody variable domain

SEQ ID NO: 4002 - protein, 448 aa, Artificial Sequence; identical to SEQ ID NO: 798
  Description of Artificial Sequence: Synthetic Antibody variable domain

SEQ ID NO: 4003 - protein, 211 aa, Artificial Sequence; identical to SEQ ID NO: 799
  Description of Artificial Sequence: Synthetic Antibody variable domain

SEQ ID NO: 4004 - protein, 446 aa, Artificial Sequence; identical to SEQ ID NO: 800
  Description of Artificial Sequence: Synthetic Antibody variable domain

SEQ ID NO: 4005 - protein, 105 aa, Homo sapiens; identical to SEQ ID NO: 801

SEQ ID NO: 4006 - protein, 102 aa, Homo sapiens; identical to SEQ ID NO: 802

SEQ ID NO: 4007 - protein, 449 aa, Artificial Sequence; identical to SEQ ID NO: 793
  Description of Artificial Sequence: Synthetic Antibody variable domain

SEQ ID NO: 4008 - protein, 211 aa, Artificial Sequence; identical to SEQ ID NO: 794
  Description of Artificial Sequence: Synthetic Antibody variable domain

SEQ ID NO: 4009 - protein, 449 aa, Artificial Sequence; identical to SEQ ID NO: 805
  Description of Artificial Sequence: Synthetic Antibody variable domain

SEQ ID NO: 4010 - protein, 211 aa, Artificial Sequence; identical to SEQ ID NO: 806
  Description of Artificial Sequence: Synthetic Antibody variable domain

SEQ ID NO: 4011 - protein, 446 aa, Artificial Sequence; identical to SEQ ID NO: 795
  Description of Artificial Sequence: Synthetic Antibody variable domain

SEQ ID NO: 4012 - protein, 446 aa, Artificial Sequence; identical to SEQ ID NO: 800
  Description of Artificial Sequence: Synthetic Antibody variable domain

SEQ ID NO: 4013 - protein, 119 aa, Artificial Sequence; identical to SEQ ID NO: 809
  Description of Artificial Sequence: Synthetic Antibody variable domain

SEQ ID NO: 4014 - protein, 104 aa, Artificial Sequence; identical to SEQ ID NO: 810
  Description of Artificial Sequence: Synthetic Antibody variable domain

SEQ ID NO: 4015 - protein, 118 aa, Artificial Sequence; identical to SEQ ID NO: 811
  Description of Artificial Sequence: Synthetic Antibody variable domain

SEQ ID NO: 4016 - protein, 118 aa, Artificial Sequence; identical to SEQ ID NO: 812
  Description of Artificial Sequence: Synthetic Antibody variable domain

SEQ ID NO: 4017 - protein, 108 aa, Artificial Sequence; identical to SEQ ID NO: 813
  Description of Artificial Sequence: Synthetic Antibody variable domain

SEQ ID NO: 4018 - protein, 108 aa, Artificial Sequence; identical to SEQ ID NO: 814
  Description of Artificial Sequence: Synthetic Antibody variable domain

SEQ ID NO: 4019 - protein, 113 aa, Artificial Sequence; identical to SEQ ID NO: 815
  Description of Artificial Sequence: Synthetic Antibody variable domain

SEQ ID NO: 4020 - protein, 113 aa, Artificial Sequence; identical to SEQ ID NO: 816
  Description of Artificial Sequence: Synthetic Antibody variable domain

SEQ ID NO: 4021 - protein, 118 aa, Artificial Sequence; identical to SEQ ID NO: 811
  Description of Artificial Sequence: Synthetic Antibody variable domain

SEQ ID NO: 4022 - protein, 118 aa, Artificial Sequence; identical to SEQ ID NO: 812
  Description of Artificial Sequence: Synthetic Antibody variable domain

SEQ ID NO: 4023 - protein, 108 aa, Artificial Sequence; identical to SEQ ID NO: 813
  Description of Artificial Sequence: Synthetic Antibody variable domain

SEQ ID NO: 4024 - protein, 108 aa, Artificial Sequence; identical to SEQ ID NO: 814
  Description of Artificial Sequence: Synthetic Antibody variable domain

SEQ ID NO: 4025 - protein, 240 aa, Artificial Sequence; identical to SEQ ID NO: 821
  Description of Artificial Sequence: Synthetic Antibody variable domain

SEQ ID NO: 4026 - protein, 462 aa, Artificial Sequence; identical to SEQ ID NO: 822
  Description of Artificial Sequence: Synthetic Antibody variable domain

SEQ ID NO: 4027 - protein, 120 aa, Artificial Sequence; identical to SEQ ID NO: 823
  Description of Artificial Sequence: Synthetic Antibody variable domain

SEQ ID NO: 4028 - protein, 112 aa, Artificial Sequence; identical to SEQ ID NO: 824
  Description of Artificial Sequence: Synthetic Antibody variable domain

SEQ ID NO: 4029 - protein, 120 aa, Artificial Sequence; identical to SEQ ID NO: 825
  Description of Artificial Sequence: Synthetic Antibody variable domain

SEQ ID NO: 4030 - protein, 112 aa, Artificial Sequence; identical to SEQ ID NO: 826
  Description of Artificial Sequence: Synthetic Antibody variable domain

SEQ ID NO: 4031 - protein, 119 aa, Artificial Sequence; identical to SEQ ID NO: 827
  Description of Artificial Sequence: Synthetic Antibody variable domain

SEQ ID NO: 4032 - protein, 113 aa, Artificial Sequence; identical to SEQ ID NO: 828
  Description of Artificial Sequence: Synthetic Antibody variable domain

SEQ ID NO: 4033 - protein, 119 aa, Artificial Sequence; identical to SEQ ID NO: 829
  Description of Artificial Sequence: Synthetic Antibody variable domain

SEQ ID NO: 4034 - protein, 113 aa, Artificial Sequence; identical to SEQ ID NO: 830
  Description of Artificial Sequence: Synthetic Antibody variable domain

SEQ ID NO: 4035 - protein, 119 aa, Artificial Sequence; identical to SEQ ID NO: 831
  Description of Artificial Sequence: Synthetic Antibody variable domain

SEQ ID NO: 4036 - protein, 113 aa, Artificial Sequence; identical to SEQ ID NO: 832
  Description of Artificial Sequence: Synthetic Antibody variable domain

SEQ ID NO: 4037 - protein, 119 aa, Artificial Sequence; identical to SEQ ID NO: 833
  Description of Artificial Sequence: Synthetic Antibody variable domain

SEQ ID NO: 4038 - protein, 113 aa, Artificial Sequence; identical to SEQ ID NO: 834
  Description of Artificial Sequence: Synthetic Antibody variable domain

SEQ ID NO: 4039 - protein, 120 aa, Artificial Sequence; identical to SEQ ID NO: 835
  Description of Artificial Sequence: Synthetic Antibody variable domain

SEQ ID NO: 4040 - protein, 112 aa, Artificial Sequence; identical to SEQ ID NO: 836
  Description of Artificial Sequence: Synthetic Antibody variable domain

SEQ ID NO: 4041 - protein, 120 aa, Artificial Sequence; identical to SEQ ID NO: 837
  Description of Artificial Sequence: Synthetic Antibody variable domain

SEQ ID NO: 4042 - protein, 112 aa, Artificial Sequence; identical to SEQ ID NO: 838
  Description of Artificial Sequence: Synthetic Antibody variable domain

SEQ ID NO: 4043 - protein, 121 aa, Artificial Sequence; identical to SEQ ID NO: 839
  Description of Artificial Sequence: Synthetic Antibody variable domain

SEQ ID NO: 4044 - protein, 121 aa, Artificial Sequence; identical to SEQ ID NO: 840
  Description of Artificial Sequence: Synthetic Antibody variable domain

SEQ ID NO: 4045 - protein, 107 aa, Artificial Sequence
  Description of Artificial Sequence: Synthetic Antibody variable domain
DIRMTQSPSSLSASVGDRVTITCRASQGISNYLAWYQQKPGKVPKFLIYAASTLQSGVPSRFSGSGSGTDFTLTISSLQPEDVATYYCQKYNSAPWTFGQGTKVEIK

SEQ ID NO: 4046 - protein, 119 aa, Artificial Sequence; identical to SEQ ID NO: 842
  Description of Artificial Sequence: Synthetic Antibody variable domain

SEQ ID NO: 4047 - protein, 113 aa, Artificial Sequence; identical to SEQ ID NO: 843
  Description of Artificial Sequence: Synthetic Antibody variable domain

SEQ ID NO: 4048 - protein, 240 aa, Artificial Sequence; identical to SEQ ID NO: 821
  Description of Artificial Sequence: Synthetic Antibody variable domain

SEQ ID NO: 4049 - protein, 462 aa, Artificial Sequence; identical to SEQ ID NO: 822
  Description of Artificial Sequence: Synthetic Antibody variable domain

SEQ ID NO: 4050 - protein, 239 aa, Artificial Sequence; identical to SEQ ID NO: 846
  Description of Artificial Sequence: Synthetic Antibody variable domain

SEQ ID NO: 4051 - protein, 595 aa, Artificial Sequence; identical to SEQ ID NO: 847
  Description of Artificial Sequence: Synthetic Antibody variable domain

SEQ ID NO: 4052 - protein, 105 aa, Homo sapiens; identical to SEQ ID NO: 801

SEQ ID NO: 4053 - protein, 102 aa, Homo sapiens; identical to SEQ ID NO: 802

SEQ ID NO: 4054 - protein, 569 aa, Homo sapiens; identical to SEQ ID NO: 850

SEQ ID NO: 4055 - protein, 219 aa, Homo sapiens; identical to SEQ ID NO: 851

SEQ ID NO: 4056 - protein, 240 aa, Artificial Sequence; identical to SEQ ID NO: 821
  Description of Artificial Sequence: Synthetic Antibody variable domain

SEQ ID NO: 4057 - protein, 462 aa, Artificial Sequence; identical to SEQ ID NO: 822
  Description of Artificial Sequence: Synthetic Antibody variable domain

SEQ ID NO: 4058 - protein, 113 aa, Artificial Sequence; identical to SEQ ID NO: 816
  Description of Artificial Sequence: Synthetic Antibody variable domain

SEQ ID NO: 4059 - protein, 113 aa, Artificial Sequence; identical to SEQ ID NO: 815
  Description of Artificial Sequence: Synthetic Antibody variable domain

SEQ ID NO: 4060 - protein, 240 aa, Artificial Sequence; identical to SEQ ID NO: 821
  Description of Artificial Sequence: Synthetic Antibody variable domain

SEQ ID NO: 4061 - protein, 462 aa, Artificial Sequence; identical to SEQ ID NO: 822
  Description of Artificial Sequence: Synthetic Antibody variable domain

SEQ ID NO: 4062 - protein, 137 aa, Mus musculus; identical to SEQ ID NO: 858

SEQ ID NO: 4063 - protein, 133 aa, Mus musculus; identical to SEQ ID NO: 859

SEQ ID NO: 4064 - protein, 112 aa, Artificial Sequence; identical to SEQ ID NO: 860
  Description of Artificial Sequence: Synthetic Antibody variable domain

SEQ ID NO: 4065 - protein, 119 aa, Artificial Sequence; identical to SEQ ID NO: 861
  Description of Artificial Sequence: Synthetic Antibody variable domain

SEQ ID NO: 4066 - protein, 112 aa, Mus musculus; identical to SEQ ID NO: 860

SEQ ID NO: 4067 - protein, 119 aa, Mus musculus; identical to SEQ ID NO: 861

SEQ ID NO: 4068 - protein, 112 aa, Mus musculus; identical to SEQ ID NO: 864

SEQ ID NO: 4069 - protein, 119 aa, Mus musculus; identical to SEQ ID NO: 861

SEQ ID NO: 4070 - protein, 112 aa, Artificial Sequence; identical to SEQ ID NO: 860
  Description of Artificial Sequence: Synthetic Antibody variable domain

SEQ ID NO: 4071 - protein, 119 aa, Artificial Sequence; identical to SEQ ID NO: 861
  Description of Artificial Sequence: Synthetic Antibody variable domain

SEQ ID NO: 4072 - protein, 115 aa, Artificial Sequence; identical to SEQ ID NO: 868
  Description of Artificial Sequence: Synthetic Antibody variable domain

SEQ ID NO: 4073 - protein, 108 aa, Artificial Sequence; identical to SEQ ID NO: 869
  Description of Artificial Sequence: Synthetic Antibody variable domain

SEQ ID NO: 4074 - protein, 115 aa, Artificial Sequence; identical to SEQ ID NO: 870
  Description of Artificial Sequence: Synthetic Antibody variable domain

SEQ ID NO: 4075 - protein, 111 aa, Artificial Sequence; identical to SEQ ID NO: 871
  Description of Artificial Sequence: Synthetic Antibody variable domain

SEQ ID NO: 4076 - protein, 518 aa, Artificial Sequence; identical to SEQ ID NO: 872
  Description of Artificial Sequence: Synthetic scFv

SEQ ID NO: 4077 - protein, 524 aa, Artificial Sequence; identical to SEQ ID NO: 873
  Description of Artificial Sequence: Synthetic scFv

SEQ ID NO: 4078 - protein, 248 aa, Artificial Sequence; identical to SEQ ID NO: 874
  Description of Artificial Sequence: Synthetic scFv

SEQ ID NO: 4079 - protein, 225 aa, Artificial Sequence; identical to SEQ ID NO: 875
  Description of Artificial Sequence: Synthetic scFv

SEQ ID NO: 4080 - protein, 244 aa, Artificial Sequence; identical to SEQ ID NO: 876
  Description of Artificial Sequence: Synthetic scFv

SEQ ID NO: 4081 - protein, 230 aa, Artificial Sequence; identical to SEQ ID NO: 877
  Description of Artificial Sequence: Synthetic scFv

SEQ ID NO: 4082 - protein, 241 aa, Artificial Sequence; identical to SEQ ID NO: 878
  Description of Artificial Sequence: Synthetic scFv

SEQ ID NO: 4083 - protein, 249 aa, Artificial Sequence; identical to SEQ ID NO: 879
  Description of Artificial Sequence: Synthetic scFv

SEQ ID NO: 4084 - protein, 244 aa, Artificial Sequence; identical to SEQ ID NO: 880
  Description of Artificial Sequence: Synthetic scFv

SEQ ID NO: 4085 - protein, 243 aa, Artificial Sequence; identical to SEQ ID NO: 881
  Description of Artificial Sequence: Synthetic scFv

SEQ ID NO: 4086 - protein, 241 aa, Artificial Sequence; identical to SEQ ID NO: 882
  Description of Artificial Sequence: Synthetic scFv

SEQ ID NO: 4087 - protein, 239 aa, Artificial Sequence; identical to SEQ ID NO: 883
  Description of Artificial Sequence: Synthetic scFv

SEQ ID NO: 4088 - protein, 239 aa, Artificial Sequence; identical to SEQ ID NO: 884
  Description of Artificial Sequence: Synthetic scFv

SEQ ID NO: 4089 - protein, 239 aa, Artificial Sequence; identical to SEQ ID NO: 885
  Description of Artificial Sequence: Synthetic scFv

SEQ ID NO: 4090 - protein, 239 aa, Artificial Sequence; identical to SEQ ID NO: 886
  Description of Artificial Sequence: Synthetic scFv

SEQ ID NO: 4091 - protein, 239 aa, Artificial Sequence; identical to SEQ ID NO: 887
  Description of Artificial Sequence: Synthetic scFv

SEQ ID NO: 4092 - protein, 239 aa, Artificial Sequence; identical to SEQ ID NO: 888
  Description of Artificial Sequence: Synthetic scFv

SEQ ID NO: 4093 - protein, 239 aa, Artificial Sequence; identical to SEQ ID NO: 889
  Description of Artificial Sequence: Synthetic scFv

SEQ ID NO: 4094 - protein, 239 aa, Artificial Sequence; identical to SEQ ID NO: 890
  Description of Artificial Sequence: Synthetic scFv

SEQ ID NO: 4095 - protein, 239 aa, Artificial Sequence; identical to SEQ ID NO: 891
  Description of Artificial Sequence: Synthetic scFv

SEQ ID NO: 4096 - protein, 239 aa, Artificial Sequence; identical to SEQ ID NO: 892
  Description of Artificial Sequence: Synthetic scFv

SEQ ID NO: 4097 - protein, 239 aa, Artificial Sequence; identical to SEQ ID NO: 893
  Description of Artificial Sequence: Synthetic scFv

SEQ ID NO: 4098 - protein, 239 aa, Artificial Sequence; identical to SEQ ID NO: 894
  Description of Artificial Sequence: Synthetic scFv

SEQ ID NO: 4099 - protein, 239 aa, Artificial Sequence; identical to SEQ ID NO: 895
  Description of Artificial Sequence: Synthetic scFv

SEQ ID NO: 4100 - protein, 239 aa, Artificial Sequence; identical to SEQ ID NO: 896
  Description of Artificial Sequence: Synthetic scFv

SEQ ID NO: 4101 - protein, 100 aa, Artificial Sequence; identical to SEQ ID NO: 897
  Description of Artificial Sequence: Synthetic scFv

SEQ ID NO: 4102 - protein, 139 aa, Artificial Sequence; identical to SEQ ID NO: 898
  Description of Artificial Sequence: Synthetic scFv

SEQ ID NO: 4103 - protein, 243 aa, Artificial Sequence; identical to SEQ ID NO: 899
  Description of Artificial Sequence: Synthetic scFv

SEQ ID NO: 4104 - protein, 242 aa, Artificial Sequence; identical to SEQ ID NO: 900
  Description of Artificial Sequence: Synthetic scFv

SEQ ID NO: 4105 - protein, 115 aa, Artificial Sequence; identical to SEQ ID NO: 901
  Description of Artificial Sequence: Synthetic Antibody variable domain

SEQ ID NO: 4106 - protein, 111 aa, Artificial Sequence; identical to SEQ ID NO: 902
  Description of Artificial Sequence: Synthetic Antibody variable domain

SEQ ID NO: 4107 - protein, 117 aa, Artificial Sequence; identical to SEQ ID NO: 903
  Description of Artificial Sequence: Synthetic Antibody variable domain

SEQ ID NO: 4108 - protein, 228 aa, Artificial Sequence; identical to SEQ ID NO: 904
  Description of Artificial Sequence: Synthetic Antibody variable domain

SEQ ID NO: 4109 - protein, 120 aa, Artificial Sequence; identical to SEQ ID NO: 905
  Description of Artificial Sequence: Synthetic Antibody variable domain

SEQ ID NO: 4110 - protein, 115 aa, Artificial Sequence; identical to SEQ ID NO: 906
  Description of Artificial Sequence: Synthetic Antibody variable domain

SEQ ID NO: 4111 - protein, 118 aa, Artificial Sequence; identical to SEQ ID NO: 907
  Description of Artificial Sequence: Synthetic Antibody variable domain

SEQ ID NO: 4112 - protein, 113 aa, Artificial Sequence; identical to SEQ ID NO: 908
  Description of Artificial Sequence: Synthetic Antibody variable domain

SEQ ID NO: 4113 - protein, 119 aa, Artificial Sequence; identical to SEQ ID NO: 909
  Description of Artificial Sequence: Synthetic Antibody variable domain

SEQ ID NO: 4114 - protein, 112 aa, Artificial Sequence; identical to SEQ ID NO: 910
  Description of Artificial Sequence: Synthetic Antibody variable domain

SEQ ID NO: 4115 - protein, 119 aa, Artificial Sequence; identical to SEQ ID NO: 911
  Description of Artificial Sequence: Synthetic Antibody variable domain

SEQ ID NO: 4116 - protein, 112 aa, Artificial Sequence; identical to SEQ ID NO: 912
  Description of Artificial Sequence: Synthetic Antibody variable domain

SEQ ID NO: 4117 - protein, 117 aa, Artificial Sequence; identical to SEQ ID NO: 913
  Description of Artificial Sequence: Synthetic Antibody variable domain

SEQ ID NO: 4118 - protein, 111 aa, Artificial Sequence; identical to SEQ ID NO: 914
  Description of Artificial Sequence: Synthetic Antibody variable domain

SEQ ID NO: 4119 - protein, 117 aa, Artificial Sequence; identical to SEQ ID NO: 915
  Description of Artificial Sequence: Synthetic Antibody variable domain

SEQ ID NO: 4120 - protein, 111 aa, Artificial Sequence; identical to SEQ ID NO: 916
  Description of Artificial Sequence: Synthetic Antibody variable domain

SEQ ID NO: 4121 - protein, 120 aa, Artificial Sequence [sequence omitted]

SEQ ID NO: 4122 - protein, 107 aa, Artificial Sequence [sequence omitted]

SEQ ID NO: 4123 - protein, 109 aa, Artificial Sequence; identical to SEQ ID NO: 919
  Description of Artificial Sequence: Synthetic Antibody variable domain

SEQ ID NO: 4124 - protein, 120 aa, Artificial Sequence; identical to SEQ ID NO: 920
  Description of Artificial Sequence: Synthetic Antibody variable domain

SEQ ID NO: 4125 - protein, 109 aa, Artificial Sequence; identical to SEQ ID NO: 921
  Description of Artificial Sequence: Synthetic Antibody variable domain

SEQ ID NO: 4126 - protein, 120 aa, Artificial Sequence; identical to SEQ ID NO: 922
  Description of Artificial Sequence: Synthetic Antibody variable domain

SEQ ID NO: 4127 - protein, 109 aa, Artificial Sequence; identical to SEQ ID NO: 923
  Description of Artificial Sequence: Synthetic Antibody variable domain

SEQ ID NO: 4128 - protein, 120 aa, Artificial Sequence; identical to SEQ ID NO: 924
  Description of Artificial Sequence: Synthetic Antibody variable domain

SEQ ID NO: 4129 - protein, 20 aa, Artificial Sequence
  Description of Artificial Sequence: Synthetic Antibody variable domain
EVQLVESGGGLVQPKGSLKL

SEQ ID NO: 4130 - protein, 20 aa, Artificial Sequence
  Description of Artificial Sequence: Synthetic Antibody variable domain
DIVMTQSQKFMSTSVVDRIS

SEQ ID NO: 4131 - protein, 107 aa, Mus musculus; identical to SEQ ID NO: 927

SEQ ID NO: 4132 - protein, 119 aa, Mus musculus; identical to SEQ ID NO: 928

SEQ ID NO: 4133 - protein, 107 aa, Artificial Sequence [sequence omitted]

SEQ ID NO: 4134 - protein, 119 aa, Artificial Sequence [sequence omitted]

SEQ ID NO: 4135 - protein, 107 aa, Artificial Sequence; identical to SEQ ID NO: 931
  Description of Artificial Sequence: Synthetic Antibody variable domain

SEQ ID NO: 4136 - protein, 119 aa, Artificial Sequence; identical to SEQ ID NO: 932
  Description of Artificial Sequence: Synthetic Antibody variable domain

SEQ ID NO: 4137 - protein, 214 aa, Artificial Sequence; identical to SEQ ID NO: 933
  Description of Artificial Sequence: Synthetic Antibody variable domain

SEQ ID NO: 4138 - protein, 448 aa, Artificial Sequence; identical to SEQ ID NO: 934
  Description of Artificial Sequence: Synthetic Antibody variable domain

SEQ ID NO: 4139 - protein, 214 aa, Artificial Sequence; identical to SEQ ID NO: 935
  Description of Artificial Sequence: Synthetic Antibody variable domain

SEQ ID NO: 4140 - protein, 449 aa, Artificial Sequence; identical to SEQ ID NO: 936
  Description of Artificial Sequence: Synthetic Antibody variable domain

SEQ ID NO: 4141 - protein, 217 aa, Artificial Sequence; identical to SEQ ID NO: 937
  Description of Artificial Sequence: Synthetic Antibody variable domain

SEQ ID NO: 4142 - protein, 449 aa, Artificial Sequence; identical to SEQ ID NO: 938
  Description of Artificial Sequence: Synthetic Antibody variable domain

SEQ ID NO: 4143 - protein, 124 aa, Homo sapiens; identical to SEQ ID NO: 939

SEQ ID NO: 4144 - protein, 107 aa, Homo sapiens; identical to SEQ ID NO: 940

SEQ ID NO: 4145 - protein, 122 aa, Homo sapiens; identical to SEQ ID NO: 941

SEQ ID NO: 4146 - protein, 107 aa, Homo sapiens; identical to SEQ ID NO: 942

SEQ ID NO: 4147 - protein, 122 aa, Homo sapiens; identical to SEQ ID NO: 943

SEQ ID NO: 4148 - protein, 108 aa, Homo sapiens; identical to SEQ ID NO: 944

SEQ ID NO: 4149 - protein, 109 aa, Artificial Sequence; identical to SEQ ID NO: 945
  Description of Artificial Sequence: Synthetic Antibody variable domain

SEQ ID NO: 4150 - protein, 109 aa, Artificial Sequence; identical to SEQ ID NO: 946
  Description of Artificial Sequence: Synthetic Antibody variable domain

SEQ ID NO: 4151 - protein, 109 aa, Artificial Sequence; identical to SEQ ID NO: 947
  Description of Artificial Sequence: Synthetic Antibody variable domain

SEQ ID NO: 4152 - protein, 228 aa, Artificial Sequence; identical to SEQ ID NO: 948
  Description of Artificial Sequence: Synthetic Antibody variable domain

SEQ ID NO: 4153 - protein, 109 aa, Homo sapiens; identical to SEQ ID NO: 949

SEQ ID NO: 4154 - protein, 142 aa, Artificial Sequence; identical to SEQ ID NO: 950
  Description of Artificial Sequence: Synthetic Antibody variable domain

SEQ ID NO: 4155 - protein, 130 aa, Artificial Sequence; identical to SEQ ID NO: 951
  Description of Artificial Sequence: Synthetic Antibody variable domain

SEQ ID NO: 4156 - protein, 472 aa, Artificial Sequence; identical to SEQ ID NO: 952
  Description of Artificial Sequence: Synthetic Antibody variable domain

SEQ ID NO: 4157 - protein, 236 aa, Artificial Sequence; identical to SEQ ID NO: 953
  Description of Artificial Sequence: Synthetic Antibody variable domain

SEQ ID NO: 4158 - protein, 628 aa, Artificial Sequence; identical to SEQ ID NO: 954
  Description of Artificial Sequence: Synthetic Antibody variable domain

SEQ ID NO: 4159 - protein, 643 aa, Artificial Sequence; identical to SEQ ID NO: 955
  Description of Artificial Sequence: Synthetic Antibody variable domain

SEQ ID NO: 4160 - protein, 214 aa, Mus musculus; identical to SEQ ID NO: 956

SEQ ID NO: 4161 - protein, 220 aa, Mus musculus; identical to SEQ ID NO: 957

SEQ ID NO: 4162 - protein, 233 aa, Artificial Sequence; identical to SEQ ID NO: 958
  Description of Artificial Sequence: Synthetic Antibody variable domain

SEQ ID NO: 4163 - protein, 467 aa, Artificial Sequence; identical to SEQ ID NO: 959
  Description of Artificial Sequence: Synthetic Antibody variable domain

SEQ ID NO: 4164 - protein, 219 aa, Artificial Sequence; identical to SEQ ID NO: 960
  Description of Artificial Sequence: Synthetic Antibody variable domain

SEQ ID NO: 4165 - protein, 234 aa, Artificial Sequence; identical to SEQ ID NO: 961
  Description of Artificial Sequence: Synthetic Antibody variable domain

SEQ ID NO: 4166 - protein, 450 aa, Artificial Sequence; identical to SEQ ID NO: 962
  Description of Artificial Sequence: Synthetic Antibody variable domain

SEQ ID NO: 4167 - protein, 450 aa, Artificial Sequence; identical to SEQ ID NO: 963
  Description of Artificial Sequence: Synthetic Antibody variable domain

SEQ ID NO: 4168 - protein, 214 aa, Artificial Sequence; identical to SEQ ID NO: 964
  Description of Artificial Sequence: Synthetic Antibody variable domain

SEQ ID NO: 4169 - protein, 129 aa, Artificial Sequence; identical to SEQ ID NO: 965
  Description of Artificial Sequence: Synthetic Antibody variable domain

SEQ ID NO: 4170 - protein, 111 aa, Artificial Sequence; identical to SEQ ID NO: 966
  Description of Artificial Sequence: Synthetic Antibody variable domain

SEQ ID NO: 4171 - protein, 121 aa, Artificial Sequence; identical to SEQ ID NO: 967
  Description of Artificial Sequence: Synthetic Antibody variable domain

SEQ ID NO: 4172 - protein, 107 aa, Artificial Sequence; identical to SEQ ID NO: 968
  Description of Artificial Sequence: Synthetic Antibody variable domain

SEQ ID NO: 4173 - protein, 451 aa, Artificial Sequence; identical to SEQ ID NO: 969
  Description of Artificial Sequence: Synthetic Antibody variable domain

SEQ ID NO: 4174 - protein, 469 aa, Artificial Sequence; identical to SEQ ID NO: 970
  Description of Artificial Sequence: Synthetic Antibody variable domain

SEQ ID NO: 4175 - protein, 233 aa, Artificial Sequence; identical to SEQ ID NO: 971
  Description of Artificial Sequence: Synthetic Antibody variable domain

SEQ ID NO: 4176 - protein, 450 aa, Artificial Sequence; identical to SEQ ID NO: 972
  Description of Artificial Sequence: Synthetic Antibody variable domain

SEQ ID NO: 4177 - protein, 263 aa, Artificial Sequence; identical to SEQ ID NO: 973
  Description of Artificial Sequence: Synthetic scFv

SEQ ID NO: 4178 - protein, 242 aa, Artificial Sequence; identical to SEQ ID NO: 974
  Description of Artificial Sequence: Synthetic scFv

SEQ ID NO: 4179 - protein, 477 aa, Artificial Sequence; identical to SEQ ID NO: 975
  Description of Artificial Sequence: Synthetic scFv

SEQ ID NO: 4180 - protein, 291 aa, Artificial Sequence; identical to SEQ ID NO: 976
  Description of Artificial Sequence: Synthetic scFv

SEQ ID NO: 4181 - protein, 291 aa, Artificial Sequence; identical to SEQ ID NO: 977
  Description of Artificial Sequence: Synthetic scFv

SEQ ID NO: 4182 - protein, 665 aa, Artificial Sequence; identical to SEQ ID NO: 978
  Description of Artificial Sequence: Synthetic scFv

SEQ ID NO: 4183 - protein, 278 aa, Artificial Sequence; identical to SEQ ID NO: 979
  Description of Artificial Sequence: Synthetic scFv

SEQ ID NO: 4184 - protein, 280 aa, Artificial Sequence; identical to SEQ ID NO: 980
  Description of Artificial Sequence: Synthetic scFv

SEQ ID NO: 4185 - protein, 268 aa, Artificial Sequence; identical to SEQ ID NO: 1146
  Description of Artificial Sequence: Synthetic Construct

SEQ ID NO: 4186 - protein, 153 aa, Artificial Sequence; identical to SEQ ID NO: 1147
  Description of Artificial Sequence: Synthetic Construct

SEQ ID NO: 4187 - protein, 319 aa, Artificial Sequence; identical to SEQ ID NO: 1148
  Description of Artificial Sequence: Synthetic Construct

SEQ ID NO: 4188 - protein, 528 aa, Artificial Sequence; identical to SEQ ID NO: 1149
  Description of Artificial Sequence: Synthetic Payload

SEQ ID NO: 4189 - protein, 579 aa, Artificial Sequence; identical to SEQ ID NO: 1150
  Description of Artificial Sequence: Synthetic Payload

SEQ ID NO: 4190 - protein, 607 aa, Artificial Sequence; identical to SEQ ID NO: 1151
  Description of Artificial Sequence: Synthetic Payload

SEQ ID NO: 4191 - protein, 607 aa, Artificial Sequence; identical to SEQ ID NO: 1152
  Description of Artificial Sequence: Synthetic Payload

SEQ ID NO: 4192 - protein, 607 aa, Artificial Sequence; identical to SEQ ID NO: 1153
  Description of Artificial Sequence: Synthetic Payload

SEQ ID NO: 4193 - protein, 413 aa, Artificial Sequence; identical to SEQ ID NO: 1154
  Description of Artificial Sequence: Synthetic Payload

SEQ ID NO: 4194 - protein, 525 aa, Artificial Sequence; identical to SEQ ID NO: 1155
  Description of Artificial Sequence: Synthetic Payload

SEQ ID NO: 4195 - protein, 576 aa, Artificial Sequence; identical to SEQ ID NO: 1156
  Description of Artificial Sequence: Synthetic Payload

SEQ ID NO: 4196 - protein, 576 aa, Artificial Sequence; identical to SEQ ID NO: 1157
  Description of Artificial Sequence: Synthetic Payload

SEQ ID NO: 4197 - protein, 431 aa, Artificial Sequence; identical to SEQ ID NO: 745
  Description of Artificial Sequence: Synthetic Payload

SEQ ID NO: 4198 - protein, 396 aa, Artificial Sequence; identical to SEQ ID NO: 747
  Description of Artificial Sequence: Synthetic Construct

SEQ ID NO: 4199 - protein, 543 aa, Artificial Sequence; identical to SEQ ID NO: 1160
  Description of Artificial Sequence: Synthetic Construct

SEQ ID NO: 4200 - protein, 594 aa, Artificial Sequence; identical to SEQ ID NO: 1161
  Description of Artificial Sequence: Synthetic Construct

SEQ ID NO: 4201 - protein, 540 aa, Artificial Sequence; identical to SEQ ID NO: 1162
  Description of Artificial Sequence: Synthetic Construct

SEQ ID NO: 4202 - protein, 591 aa, Artificial Sequence; identical to SEQ ID NO: 1163
  Description of Artificial Sequence: Synthetic Construct

SEQ ID NO: 4203 - protein, 505 aa, Artificial Sequence; identical to SEQ ID NO: 1164
  Description of Artificial Sequence: Synthetic Construct

SEQ ID NO: 4204 - protein, 556 aa, Artificial Sequence; identical to SEQ ID NO: 1165
  Description of Artificial Sequence: Synthetic Construct

SEQ ID NO: 4205 - protein, 505 aa, Artificial Sequence; identical to SEQ ID NO: 1166
  Description of Artificial Sequence: Synthetic Construct

SEQ ID NO: 4206 - protein, 556 aa, Artificial Sequence; identical to SEQ ID NO: 1167
  Description of Artificial Sequence: Synthetic Construct

SEQ ID NO: 4207 - protein, 490 aa, Artificial Sequence; identical to SEQ ID NO: 1168
  Description of Artificial Sequence: Synthetic Construct

SEQ ID NO: 4208 - protein, 599 aa, Artificial Sequence; identical to SEQ ID NO: 1169
  Description of Artificial Sequence: Synthetic Construct

SEQ ID NO: 4209 - protein, 650 aa, Artificial Sequence; identical to SEQ ID NO: 1170
  Description of Artificial Sequence: Synthetic Construct

SEQ ID NO: 4210 - protein, 686 aa, Artificial Sequence; identical to SEQ ID NO: 1171
  Description of Artificial Sequence: Synthetic Construct

SEQ ID NO: 4211 - protein, 107 aa, Homo sapiens; identical to SEQ ID NO: 192

SEQ ID NO: 4212 - protein, 159 aa, Escherichia coli [sequence omitted]

SEQ ID NO: 4213 - protein, 187 aa, Homo sapiens; identical to SEQ ID NO: 1

SEQ ID NO: 4214 - protein, 327 aa, Homo sapiens; identical to SEQ ID NO: 195

SEQ ID NO: 4215 - protein, 189 aa, Homo sapiens; identical to SEQ ID NO: 196

SEQ ID NO: 4216 - protein, 260 aa, Homo sapiens; identical to SEQ ID NO: 197

SEQ ID NO: 4217 - protein, 231 aa, Homo sapiens; identical to SEQ ID NO: 198

SEQ ID NO: 4218 - protein, 67 aa, Homo sapiens; identical to SEQ ID NO: 3093

SEQ ID NO: 4219 - protein, 159 aa, Escherichia coli [sequence omitted]

SEQ ID NO: 4220 - protein, 107 aa, Homo sapiens; identical to SEQ ID NO: 192

SEQ ID NO: 4221 - protein, 159 aa, Escherichia coli [sequence omitted]

SEQ ID NO: 4222 - protein, 107 aa, Homo sapiens; identical to SEQ ID NO: 192

SEQ ID NO: 4223 - DNA, 561 bp, Homo sapiens; identical to SEQ ID NO: 1178

SEQ ID NO: 4224 - DNA, 477 bp, Artificial Sequence; identical to SEQ ID NO: 1180
  Description of Artificial Sequence: Synthetic Destabilizing Domain (DD)

SEQ ID NO: 4225 - DNA, 717 bp, Artificial Sequence; identical to SEQ ID NO: 1182
  Description of Artificial Sequence: Synthetic polynucleotide

SEQ ID NO: 4226 - DNA, 18 bp, Artificial Sequence
  Description of Artificial Sequence: Synthetic oligonucleotide
ggtggctctggtggtggt

SEQ ID NO: 4227 - DNA, 18 bp, Artificial Sequence
  Description of Artificial Sequence: Synthetic oligonucleotide
ggaggtagtggtggaggc

SEQ ID NO: 4228 - DNA, 1305 bp, Artificial Sequence; identical to SEQ ID NO: 142
  Description of Artificial Sequence: Synthetic polynucleotide

SEQ ID NO: 4229 - DNA, 1302 bp, Artificial Sequence; identical to SEQ ID NO: 143
  Description of Artificial Sequence: Synthetic polynucleotide

SEQ ID NO: 4230 - DNA, 1215 bp, Artificial Sequence; identical to SEQ ID NO: 144
  Description of Artificial Sequence: Synthetic polynucleotide

SEQ ID NO: 4231 - protein, 187 aa, Homo sapiens; identical to SEQ ID NO: 1

SEQ ID NO: 4232 - DNA, 561 bp, Homo sapiens; identical to SEQ ID NO: 1178

SEQ ID NO: 4233 - protein, 135 aa, Homo sapiens
MGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 4234 - DNA, 406 bp, Homo sapiens; identical to SEQ ID NO: 1189

SEQ ID NO: 4235 - protein, 129 aa, Homo sapiens; identical to SEQ ID NO: 1190

SEQ ID NO: 4236 - DNA, 389 bp, Homo sapiens; identical to SEQ ID NO: 1191

SEQ ID NO: 4237 - protein, 97 aa, Homo sapiens [sequence omitted]

SEQ ID NO: 4238 - protein, 187 aa, Homo sapiens; identical to SEQ ID NO: 1193

SEQ ID NO: 4239 - DNA, 554 bp, Homo sapiens; identical to SEQ ID NO: 1194

SEQ ID NO: 4240 - DNA, 561 bp, Artificial Sequence; identical to SEQ ID NO: 73
  Description of Artificial Sequence: Synthetic Destabilizing Domain (DD)

SEQ ID NO: 4241 - DNA, 561 bp, Artificial Sequence; identical to SEQ ID NO: 72
  Description of Artificial Sequence: Synthetic Destabilizing Domain (DD)

SEQ ID NO: 4242 - DNA, 561 bp, Artificial Sequence; identical to SEQ ID NO: 74
  Description of Artificial Sequence: Synthetic Destabilizing Domain (DD)

SEQ ID NO: 4243 - DNA, 558 bp, Artificial Sequence; identical to SEQ ID NO: 87
  Description of Artificial Sequence: Synthetic Destabilizing Domain (DD)

SEQ ID NO: 4244 - DNA, 561 bp, Artificial Sequence; identical to SEQ ID NO: 75
  Description of Artificial Sequence: Synthetic Destabilizing Domain (DD)

SEQ ID NO: 4245 - DNA, 558 bp, Artificial Sequence; identical to SEQ ID NO: 88
  Description of Artificial Sequence: Synthetic Destabilizing Domain (DD)

SEQ ID NO: 4246 - DNA, 561 bp, Artificial Sequence; identical to SEQ ID NO: 76
  Description of Artificial Sequence: Synthetic Destabilizing Domain (DD)

SEQ ID NO: 4247 - DNA, 561 bp, Artificial Sequence; identical to SEQ ID NO: 77
  Description of Artificial Sequence: Synthetic Destabilizing Domain (DD)

SEQ ID NO: 4248 - DNA, 561 bp, Artificial Sequence; identical to SEQ ID NO: 78
  Description of Artificial Sequence: Synthetic Destabilizing Domain (DD)

SEQ ID NO: 4249 - DNA, 558 bp, Artificial Sequence; identical to SEQ ID NO: 89
  Description of Artificial Sequence: Synthetic Destabilizing Domain (DD)

SEQ ID NO: 4250 - DNA, 561 bp, Artificial Sequence; identical to SEQ ID NO: 79
  Description of Artificial Sequence: Synthetic Destabilizing Domain (DD)

SEQ ID NO: 4251 - DNA, 558 bp, Artificial Sequence; identical to SEQ ID NO: 132
  Description of Artificial Sequence: Synthetic Destabilizing Domain (DD)

SEQ ID NO: 4252 - DNA, 561 bp, Artificial Sequence; identical to SEQ ID NO: 80
  Description of Artificial Sequence: Synthetic Destabilizing Domain (DD)

SEQ ID NO: 4253 - DNA, 558 bp, Artificial Sequence; identical to SEQ ID NO: 133
  Description of Artificial Sequence: Synthetic Destabilizing Domain (DD)

SEQ ID NO: 4254 - DNA, 561 bp, Artificial Sequence; identical to SEQ ID NO: 81
  Description of Artificial Sequence: Synthetic Destabilizing Domain (DD)

SEQ ID NO: 4255 - DNA, 558 bp, Artificial Sequence; identical to SEQ ID NO: 134
  Description of Artificial Sequence: Synthetic Destabilizing Domain (DD)

SEQ ID NO: 4256 - DNA, 561 bp, Artificial Sequence; identical to SEQ ID NO: 82
  Description of Artificial Sequence: Synthetic Destabilizing Domain (DD)

SEQ ID NO: 4257 - DNA, 561 bp, Artificial Sequence; identical to SEQ ID NO: 83
  Description of Artificial Sequence: Synthetic Destabilizing Domain (DD)

SEQ ID NO: 4258 - DNA, 561 bp, Artificial Sequence; identical to SEQ ID NO: 83
  Description of Artificial Sequence: Synthetic Destabilizing Domain (DD)

SEQ ID NO: 4259 - DNA, 561 bp, Artificial Sequence; identical to SEQ ID NO: 84
  Description of Artificial Sequence: Synthetic Destabilizing Domain (DD)

SEQ ID NO: 4260 - DNA, 561 bp, Artificial Sequence; identical to SEQ ID NO: 85
  Description of Artificial Sequence: Synthetic Destabilizing Domain (DD)

SEQ ID NO: 4261 - DNA, 561 bp, Artificial Sequence; identical to SEQ ID NO: 135
  Description of Artificial Sequence: Synthetic Destabilizing Domain (DD)

SEQ ID NO: 4262 - DNA, 558 bp, Artificial Sequence; identical to SEQ ID NO: 86
  Description of Artificial Sequence: Synthetic Destabilizing Domain (DD)

SEQ ID NO: 4263 - DNA, 561 bp, Artificial Sequence; identical to SEQ ID NO: 90
  Description of Artificial Sequence: Synthetic Destabilizing Domain (DD)

SEQ ID NO: 4264 - DNA, 561 bp, Artificial Sequence; identical to SEQ ID NO: 91
  Description of Artificial Sequence: Synthetic Destabilizing Domain (DD)

SEQ ID NO: 4265 - DNA, 561 bp, Artificial Sequence; identical to SEQ ID NO: 92
  Description of Artificial Sequence: Synthetic Destabilizing Domain (DD)

SEQ ID NO: 4266 - DNA, 561 bp, Artificial Sequence; identical to SEQ ID NO: 93
  Description of Artificial Sequence: Synthetic Destabilizing Domain (DD)

SEQ ID NO: 4267 - DNA, 561 bp, Artificial Sequence; identical to SEQ ID NO: 94
  Description of Artificial Sequence: Synthetic Destabilizing Domain (DD)

SEQ ID NO: 4268 - DNA, 561 bp, Artificial Sequence; identical to SEQ ID NO: 95
  Description of Artificial Sequence: Synthetic Destabilizing Domain (DD)

SEQ ID NO: 4269 - DNA, 561 bp, Artificial Sequence; identical to SEQ ID NO: 96
  Description of Artificial Sequence: Synthetic Destabilizing Domain (DD)

SEQ ID NO: 4270 - DNA, 561 bp, Artificial Sequence; identical to SEQ ID NO: 97
  Description of Artificial Sequence: Synthetic Destabilizing Domain (DD)

SEQ ID NO: 4271 - DNA, 561 bp, Artificial Sequence; identical to SEQ ID NO: 98
  Description of Artificial Sequence: Synthetic Destabilizing Domain (DD)

SEQ ID NO: 4272 - DNA, 561 bp, Artificial Sequence; identical to SEQ ID NO: 99
  Description of Artificial Sequence: Synthetic Destabilizing Domain (DD)

SEQ ID NO: 4273 - DNA, 561 bp, Artificial Sequence; identical to SEQ ID NO: 100
  Description of Artificial Sequence: Synthetic Destabilizing Domain (DD)

SEQ ID NO: 4274 - DNA, 561 bp, Artificial Sequence; identical to SEQ ID NO: 101
  Description of Artificial Sequence: Synthetic Destabilizing Domain (DD)

SEQ ID NO: 4275 - DNA, 561 bp, Artificial Sequence; identical to SEQ ID NO: 102
  Description of Artificial Sequence: Synthetic Destabilizing Domain (DD)

SEQ ID NO: 4276 - DNA, 561 bp, Artificial Sequence; identical to SEQ ID NO: 103
  Description of Artificial Sequence: Synthetic Destabilizing Domain (DD)

SEQ ID NO: 4277 - DNA, 561 bp, Artificial Sequence; identical to SEQ ID NO: 104
  Description of Artificial Sequence: Synthetic Destabilizing Domain (DD)

SEQ ID NO: 4278 - DNA, 561 bp, Artificial Sequence; identical to SEQ ID NO: 105
  Description of Artificial Sequence: Synthetic Destabilizing Domain (DD)

SEQ ID NO: 4279 - DNA, 561 bp, Artificial Sequence; identical to SEQ ID NO: 106
  Description of Artificial Sequence: Synthetic Destabilizing Domain (DD)

SEQ ID NO: 4280 - DNA, 561 bp, Artificial Sequence; identical to SEQ ID NO: 107
  Description of Artificial Sequence: Synthetic Destabilizing Domain (DD)

SEQ ID NO: 4281 - DNA, 561 bp, Artificial Sequence; identical to SEQ ID NO: 108
  Description of Artificial Sequence: Synthetic Destabilizing Domain (DD)

SEQ ID NO: 4282 - DNA, 561 bp, Artificial Sequence; identical to SEQ ID NO: 109
  Description of Artificial Sequence: Synthetic Destabilizing Domain (DD)

SEQ ID NO: 4283 - DNA, 561 bp, Artificial Sequence; identical to SEQ ID NO: 110
  Description of Artificial Sequence: Synthetic Destabilizing Domain (DD)

SEQ ID NO: 4284 - DNA, 561 bp, Artificial Sequence; identical to SEQ ID NO: 111
  Description of Artificial Sequence: Synthetic Destabilizing Domain (DD)

SEQ ID NO: 4285 - DNA, 561 bp, Artificial Sequence; identical to SEQ ID NO: 112
  Description of Artificial Sequence: Synthetic Destabilizing Domain (DD)

SEQ ID NO: 4286 - DNA, 561 bp, Artificial Sequence; identical to SEQ ID NO: 113
  Description of Artificial Sequence: Synthetic Destabilizing Domain (DD)

SEQ ID NO: 4287 - DNA, 561 bp, Artificial Sequence; identical to SEQ ID NO: 114
  Description of Artificial Sequence: Synthetic Destabilizing Domain (DD)

SEQ ID NO: 4288 - DNA, 561 bp, Artificial Sequence; identical to SEQ ID NO: 115
  Description of Artificial Sequence: Synthetic Destabilizing Domain (DD)

SEQ ID NO: 4289 - DNA, 561 bp, Artificial Sequence; identical to SEQ ID NO: 116
  Description of Artificial Sequence: Synthetic Destabilizing Domain (DD)

SEQ ID NO: 4290 - DNA, 561 bp, Artificial Sequence; identical to SEQ ID NO: 117
  Description of Artificial Sequence: Synthetic Destabilizing Domain (DD)

SEQ ID NO: 4291 - DNA, 561 bp, Artificial Sequence; identical to SEQ ID NO: 118
  Description of Artificial Sequence: Synthetic Destabilizing Domain (DD)

SEQ ID NO: 4292 - DNA, 561 bp, Artificial Sequence; identical to SEQ ID NO: 119
  Description of Artificial Sequence: Synthetic Destabilizing Domain (DD)

SEQ ID NO: 4293 - DNA, 561 bp, Artificial Sequence; identical to SEQ ID NO: 120
  Description of Artificial Sequence: Synthetic Destabilizing Domain (DD)

SEQ ID NO: 4294 - DNA, 561 bp, Artificial Sequence; identical to SEQ ID NO: 121
  Description of Artificial Sequence: Synthetic Destabilizing Domain (DD)

SEQ ID NO: 4295 - DNA, 561 bp, Artificial Sequence; identical to SEQ ID NO: 122
  Description of Artificial Sequence: Synthetic Destabilizing Domain (DD)

SEQ ID NO: 4296 - DNA, 561 bp, Artificial Sequence; identical to SEQ ID NO: 123
  Description of Artificial Sequence: Synthetic Destabilizing Domain (DD)

SEQ ID NO: 4297 - DNA, 561 bp, Artificial Sequence; identical to SEQ ID NO: 124
  Description of Artificial Sequence: Synthetic Destabilizing Domain (DD)

SEQ ID NO: 4298 - DNA, 558 bp, Artificial Sequence; identical to SEQ ID NO: 125
  Description of Artificial Sequence: Synthetic Destabilizing Domain (DD)

SEQ ID NO: 4299 - protein, 186 aa, Artificial Sequence; identical to SEQ ID NO: 33
  Description of Artificial Sequence: Synthetic Destabilizing Domain (DD)

SEQ ID NO: 4300 - DNA, 558 bp, Artificial Sequence; identical to SEQ ID NO: 126
  Description of Artificial Sequence: Synthetic Destabilizing Domain (DD)

SEQ ID NO: 4301 - protein, 187 aa, Artificial Sequence; identical to SEQ ID NO: 18
  Description of Artificial Sequence: Synthetic Destabilizing Domain (DD)

SEQ ID NO: 4302 - DNA, 561 bp, Artificial Sequence; identical to SEQ ID NO: 136
  Description of Artificial Sequence: Synthetic Destabilizing Domain (DD)

SEQ ID NO: 4303 - protein, 186 aa, Artificial Sequence; identical to SEQ ID NO: 42
  Description of Artificial Sequence: Synthetic Destabilizing Domain (DD)

SEQ ID NO: 4304 - DNA, 558 bp, Artificial Sequence; identical to SEQ ID NO: 127
  Description of Artificial Sequence: Synthetic Destabilizing Domain (DD)

SEQ ID NO: 4305 - protein, 187 aa, Artificial Sequence; identical to SEQ ID NO: 29
  Description of Artificial Sequence: Synthetic Destabilizing Domain (DD)

SEQ ID NO: 4306 - DNA, 561 bp, Artificial Sequence; identical to SEQ ID NO: 137
  Description of Artificial Sequence: Synthetic Destabilizing Domain (DD)

SEQ ID NO: 4307 - protein, 186 aa, Artificial Sequence; identical to SEQ ID NO: 37
  Description of Artificial Sequence: Synthetic Destabilizing Domain (DD)

SEQ ID NO: 4308 - DNA, 558 bp, Artificial Sequence; identical to SEQ ID NO: 128
  Description of Artificial Sequence: Synthetic Destabilizing Domain (DD)

SEQ ID NO: 4309 - protein, 187 aa, Artificial Sequence; identical to SEQ ID NO: 22
  Description of Artificial Sequence: Synthetic Destabilizing Domain (DD)

SEQ ID NO: 4310 - DNA, 561 bp, Artificial Sequence; identical to SEQ ID NO: 138
  Description of Artificial Sequence: Synthetic Destabilizing Domain (DD)

SEQ ID NO: 4311 - protein, 186 aa, Artificial Sequence; identical to SEQ ID NO: 1196
  Description of Artificial Sequence: Synthetic Destabilizing Domain (DD)

SEQ ID NO: 4312 - DNA, 558 bp, Artificial Sequence; identical to SEQ ID NO: 129
  Description of Artificial Sequence: Synthetic Destabilizing Domain (DD)

SEQ ID NO: 4313 - protein, 187 aa, Artificial Sequence; identical to SEQ ID NO: 53
  Description of Artificial Sequence: Synthetic Destabilizing Domain (DD)

SEQ ID NO: 4314 - DNA, 561 bp, Artificial Sequence; identical to SEQ ID NO: 139
  Description of Artificial Sequence: Synthetic Destabilizing Domain (DD)

SEQ ID NO: 4315 - protein, 159 aa, Escherichia coli [sequence omitted]

SEQ ID NO: 4316 - protein, 107 aa, Homo sapiens; identical to SEQ ID NO: 192

SEQ ID NO: 4317 - protein, 187 aa, Homo sapiens; identical to SEQ ID NO: 1

SEQ ID NO: 4318 - protein, 187 aa, Homo sapiens; identical to SEQ ID NO: 1

SEQ ID NO: 4319 - protein, 186 aa, Artificial Sequence; identical to SEQ ID NO: 61
  Description of Artificial Sequence: Synthetic Destabilizing Domain (DD)

SEQ ID NO: 4320 - DNA, 558 bp, Artificial Sequence; identical to SEQ ID NO: 130
  Description of Artificial Sequence: Synthetic Destabilizing Domain (DD)

SEQ ID NO: 4321 - protein, 187 aa, Artificial Sequence; identical to SEQ ID NO: 60
  Description of Artificial Sequence: Synthetic Destabilizing Domain (DD)

SEQ ID NO: 4322 - DNA, 561 bp, Artificial Sequence; identical to SEQ ID NO: 140
  Description of Artificial Sequence: Synthetic Destabilizing Domain (DD)

SEQ ID NO: 4323 - protein, 186 aa, Artificial Sequence; identical to SEQ ID NO: 55
  Description of Artificial Sequence: Synthetic Destabilizing Domain (DD)

SEQ ID NO: 4324 - DNA, 558 bp, Artificial Sequence; identical to SEQ ID NO: 131
  Description of Artificial Sequence: Synthetic Destabilizing Domain (DD)

SEQ ID NO: 4325 - protein, 187 aa, Artificial Sequence; identical to SEQ ID NO: 43
  Description of Artificial Sequence: Synthetic Destabilizing Domain (DD)

SEQ ID NO: 4326 - DNA, 561 bp, Artificial Sequence; identical to SEQ ID NO: 141
  Description of Artificial Sequence: Synthetic Destabilizing Domain (DD)

SEQ ID NO: 4327 - protein, 239 aa, Artificial Sequence; identical to SEQ ID NO: 1181
  Description of Artificial Sequence: Synthetic polypeptide

SEQ ID NO: 4328 - protein, 550 aa, Artificial Sequence; identical to SEQ ID NO: 58
  Description of Artificial Sequence: Synthetic Payload

SEQ ID NO: 4329 - DNA, 1650 bp, Artificial Sequence; identical to SEQ ID NO: 1261
  Description of Artificial Sequence: Synthetic Payload

SEQ ID NO: 4330 - protein, 6 aa, Artificial Sequence
  Description of Artificial Sequence: Synthetic Linker
GGSGGG

SEQ ID NO: 4331 - DNA, 1305 bp, Artificial Sequence; identical to SEQ ID NO: 142
  Description of Artificial Sequence: Synthetic polynucleotide

SEQ ID NO: 4332 - DNA, 1305 bp, Artificial Sequence; identical to SEQ ID NO: 145
  Description of Artificial Sequence: Synthetic polynucleotide

SEQ ID NO: 4333 - DNA, 1305 bp, Artificial Sequence; identical to SEQ ID NO: 146
  Description of Artificial Sequence: Synthetic polynucleotide

SEQ ID NO: 4334 - DNA, 1305 bp, Artificial Sequence; identical to SEQ ID NO: 147
  Description of Artificial Sequence: Synthetic polynucleotide

SEQ ID NO: 4335 - DNA, 1305 bp, Artificial Sequence; identical to SEQ ID NO: 148
  Description of Artificial Sequence: Synthetic polynucleotide

SEQ ID NO: 4336 - DNA, 1305 bp, Artificial Sequence; identical to SEQ ID NO: 149
  Description of Artificial Sequence: Synthetic polynucleotide

SEQ ID NO: 4337 - DNA, 1305 bp, Artificial Sequence; identical to SEQ ID NO: 150
  Description of Artificial Sequence: Synthetic polynucleotide

SEQ ID NO: 4338 - DNA, 1305 bp, Artificial Sequence; identical to SEQ ID NO: 151
  Description of Artificial Sequence: Synthetic polynucleotide

SEQ ID NO: 4339 - DNA, 1305 bp, Artificial Sequence; identical to SEQ ID NO: 152
  Description of Artificial Sequence: Synthetic polynucleotide

SEQ ID NO: 4340 - DNA, 1305 bp, Artificial Sequence; identical to SEQ ID NO: 153
  Description of Artificial Sequence: Synthetic polynucleotide

SEQ ID NO: 4341 - DNA, 1305 bp, Artificial Sequence; identical to SEQ ID NO: 154
  Description of Artificial Sequence: Synthetic polynucleotide

SEQ ID NO: 4342 - DNA, 1302 bp, Artificial Sequence; identical to SEQ ID NO: 143
  Description of Artificial Sequence: Synthetic polynucleotide

SEQ ID NO: 4343 - DNA, 1302 bp, Artificial Sequence; identical to SEQ ID NO: 155
  Description of Artificial Sequence: Synthetic polynucleotide

SEQ ID NO: 4344 - DNA, 1302 bp, Artificial Sequence; identical to SEQ ID NO: 156
  Description of Artificial Sequence: Synthetic polynucleotide

SEQ ID NO: 4345 - DNA, 1302 bp, Artificial Sequence; identical to SEQ ID NO: 157
  Description of Artificial Sequence: Synthetic polynucleotide

SEQ ID NO: 4346 - DNA, 1302 bp, Artificial Sequence; identical to SEQ ID NO: 158
  Description of Artificial Sequence: Synthetic polynucleotide

SEQ ID NO: 4347 - DNA, 1302 bp, Artificial Sequence; identical to SEQ ID NO: 159
  Description of Artificial Sequence: Synthetic polynucleotide

SEQ ID NO: 4348 - DNA, 1302 bp, Artificial Sequence; identical to SEQ ID NO: 160
  Description of Artificial Sequence: Synthetic polynucleotide

SEQ ID NO: 4349 - DNA, 1302 bp, Artificial Sequence; identical to SEQ ID NO: 161
  Description of Artificial Sequence: Synthetic polynucleotide

SEQ ID NO: 4350 - DNA, 1302 bp, Artificial Sequence; identical to SEQ ID NO: 162
  Description of Artificial Sequence: Synthetic polynucleotide

SEQ ID NO: 4351 - DNA, 1305 bp, Artificial Sequence; identical to SEQ ID NO: 154
  Description of Artificial Sequence: Synthetic polynucleotide

SEQ ID NO: 4352 - DNA, 1302 bp, Artificial Sequence; identical to SEQ ID NO: 164
  Description of Artificial Sequence: Synthetic polynucleotide

SEQ ID NO: 4353 - DNA, 1302 bp, Artificial Sequence; identical to SEQ ID NO: 186
  Description of Artificial Sequence: Synthetic Construct

SEQ ID NO: 4354 - DNA, 1302 bp, Artificial Sequence; identical to SEQ ID NO: 187
  Description of Artificial Sequence: Synthetic Construct

SEQ ID NO: 4355 - DNA, 1302 bp, Artificial Sequence; identical to SEQ ID NO: 188
  Description of Artificial Sequence: Synthetic Construct

SEQ ID NO: 4356 - DNA, 1302 bp, Artificial Sequence; identical to SEQ ID NO: 189
  Description of Artificial Sequence: Synthetic Construct

SEQ ID NO: 4357 - DNA, 1302 bp, Artificial Sequence; identical to SEQ ID NO: 190
  Description of Artificial Sequence: Synthetic Construct

SEQ ID NO: 4358 - DNA, 1302 bp, Artificial Sequence; identical to SEQ ID NO: 191
  Description of Artificial Sequence: Synthetic Construct

SEQ ID NO: 4359 - DNA, 2217 bp, Artificial Sequence; identical to SEQ ID NO: 181
  Description of Artificial Sequence: Synthetic polynucleotide

SEQ ID NO: 4360 - DNA, 2217 bp, Artificial Sequence; identical to SEQ ID NO: 182
  Description of Artificial Sequence: Synthetic polynucleotide

SEQ ID NO: 4361 - DNA, 2217 bp, Artificial Sequence; identical to SEQ ID NO: 183
  Description of Artificial Sequence: Synthetic polynucleotide

SEQ ID NO: 4362 - DNA, 2217 bp, Artificial Sequence; identical to SEQ ID NO: 184
  Description of Artificial Sequence: Synthetic polynucleotide

SEQ ID NO: 4363 - protein, 427 aa, Artificial Sequence; identical to SEQ ID NO: 1293
  Description of Artificial Sequence: Synthetic polypeptide

SEQ ID NO: 4364 - DNA, 1281 bp, Artificial Sequence; identical to SEQ ID NO: 185
  Description of Artificial Sequence: Synthetic polynucleotide

SEQ ID NO: 4365 - protein, 449 aa, Artificial Sequence; identical to SEQ ID NO: 199
  Description of Artificial Sequence: Synthetic heavy chain variable domain

SEQ ID NO: 4366 - protein, 223 aa, Artificial Sequence; identical to SEQ ID NO: 200
  Description of Artificial Sequence: Synthetic heavy chain variable domain

SEQ ID NO: 4367 - protein, 234 aa, Artificial Sequence; identical to SEQ ID NO: 201
  Description of Artificial Sequence: Synthetic heavy chain variable domain

SEQ ID NO: 4368 - protein, 460 aa, Artificial Sequence; identical to SEQ ID NO: 202
  Description of Artificial Sequence: Synthetic heavy chain variable domain

SEQ ID NO: 4369 - protein, 241 aa, Artificial Sequence; identical to SEQ ID NO: 203
  Description of Artificial Sequence: Synthetic heavy chain variable domain

SEQ ID NO: 4370 - protein, 471 aa, Artificial Sequence; identical to SEQ ID NO: 204
  Description of Artificial Sequence: Synthetic heavy chain variable domain

SEQ ID NO: 4371 - protein, 120 aa, Artificial Sequence; identical to SEQ ID NO: 205
  Description of Artificial Sequence: Synthetic heavy chain variable domain

SEQ ID NO: 4372 - protein, 111 aa, Artificial Sequence; identical to SEQ ID NO: 206
  Description of Artificial Sequence: Synthetic heavy chain variable domain

SEQ ID NO: 4373 - protein, 464 aa, Artificial Sequence; identical to SEQ ID NO: 207
  Description of Artificial Sequence: Synthetic heavy chain variable domain

SEQ ID NO: 4374 - protein, 137 aa, Artificial Sequence; identical to SEQ ID NO: 208
  Description of Artificial Sequence: Synthetic heavy chain variable domain

SEQ ID NO: 4375 - protein, 124 aa, Artificial Sequence; identical to SEQ ID NO: 209
  Description of Artificial Sequence: Synthetic heavy chain variable domain

SEQ ID NO: 4376 - protein, 130 aa, Artificial Sequence; identical to SEQ ID NO: 210
  Description of Artificial Sequence: Synthetic heavy chain variable domain

SEQ ID NO: 4377 - protein, 125 aa, Artificial Sequence; identical to SEQ ID NO: 211
  Description of Artificial Sequence: Synthetic heavy chain variable domain

SEQ ID NO: 4378 - protein, 125 aa, Artificial Sequence; identical to SEQ ID NO: 212
  Description of Artificial Sequence: Synthetic heavy chain variable domain

SEQ ID NO: 4379 - protein, 228 aa, Artificial Sequence; identical to SEQ ID NO: 213
  Description of Artificial Sequence: Synthetic heavy chain variable domain

SEQ ID NO: 4380 - protein, 98 aa, Artificial Sequence; identical to SEQ ID NO: 214
  Description of Artificial Sequence: Synthetic heavy chain variable domain
  MOD_RES (64)..(65): Any amino acid
  MOD_RES (68)..(69): Any amino acid
  MOD_RES (93)..(93): Any amino acid
  MOD_RES (98)..(98): Any amino acid

SEQ ID NO: 4381 - protein, 125 aa, Artificial Sequence; identical to SEQ ID NO: 215
  Description of Artificial Sequence: Synthetic heavy chain variable domain
  MOD_RES (76)..(76): Any amino acid

SEQ ID NO: 4382 - protein, 125 aa, Artificial Sequence; identical to SEQ ID NO: 216
  Description of Artificial Sequence: Synthetic heavy chain variable domain

SEQ ID NO: 4383 - protein, 125 aa, Artificial Sequence; identical to SEQ ID NO: 217
  Description of Artificial Sequence: Synthetic heavy chain variable domain

SEQ ID NO: 4384 - protein, 125 aa, Artificial Sequence; identical to SEQ ID NO: 218
  Description of Artificial Sequence: Synthetic heavy chain variable domain

SEQ ID NO: 4385 - protein, 125 aa, Artificial Sequence; identical to SEQ ID NO: 219
  Description of Artificial Sequence: Synthetic heavy chain variable domain

SEQ ID NO: 4386 - protein, 125 aa, Artificial Sequence; identical to SEQ ID NO: 220
  Description of Artificial Sequence: Synthetic heavy chain variable domain

SEQ ID NO: 4387 - protein, 125 aa, Artificial Sequence; identical to SEQ ID NO: 221
  Description of Artificial Sequence: Synthetic heavy chain variable domain

SEQ ID NO: 4388 - protein, 464 aa, Artificial Sequence; identical to SEQ ID NO: 207
  Description of Artificial Sequence: Synthetic heavy chain variable domain

SEQ ID NO: 4389 - protein, 120 aa, Artificial Sequence; identical to SEQ ID NO: 205
  Description of Artificial Sequence: Synthetic heavy chain variable domain

SEQ ID NO: 4390 - protein, 218 aa, Artificial Sequence; identical to SEQ ID NO: 224
  Description of Artificial Sequence: Synthetic heavy chain variable domain

SEQ ID NO: 4391 - protein, 219 aa, Artificial Sequence; identical to SEQ ID NO: 225
  Description of Artificial Sequence: Synthetic heavy chain variable domain

SEQ ID NO: 4392 - protein, 460 aa, Artificial Sequence; identical to SEQ ID NO: 202
  Description of Artificial Sequence: Synthetic heavy chain variable domain

SEQ ID NO: 4393 - protein, 242 aa, Artificial Sequence; identical to SEQ ID NO: 227
  Description of Artificial Sequence: Synthetic heavy chain variable domain

SEQ ID NO: 4394 - protein, 471 aa, Artificial Sequence; identical to SEQ ID NO: 204
  Description of Artificial Sequence: Synthetic heavy chain variable domain

SEQ ID NO: 4395 - protein, 118 aa, Artificial Sequence; identical to SEQ ID NO: 229
  Description of Artificial Sequence: Synthetic heavy chain variable domain

SEQ ID NO: 4396 - protein, 119 aa, Artificial Sequence; identical to SEQ ID NO: 230
  Description of Artificial Sequence: Synthetic heavy chain variable domain

SEQ ID NO: 4397 - protein, 112 aa, Artificial Sequence; identical to SEQ ID NO: 231
  Description of Artificial Sequence: Synthetic light chain variable domain

SEQ ID NO: 4398 - protein, 447 aa, Artificial Sequence; identical to SEQ ID NO: 232
  Description of Artificial Sequence: Synthetic light chain variable domain

SEQ ID NO: 4399 - protein, 111 aa, Artificial Sequence; identical to SEQ ID NO: 233
  Description of Artificial Sequence: Synthetic light chain variable domain

SEQ ID NO: 4400 - protein, 107 aa, Artificial Sequence; identical to SEQ ID NO: 234
  Description of Artificial Sequence: Synthetic light chain variable domain

SEQ ID NO: 4401 - protein, 214 aa, Artificial Sequence; identical to SEQ ID NO: 235
  Description of Artificial Sequence: Synthetic light chain variable domain

SEQ ID NO: 4402 - protein, 237 aa, Artificial Sequence; identical to SEQ ID NO: 236
  Description of Artificial Sequence: Synthetic light chain variable domain

SEQ ID NO: 4403 - protein, 107 aa, Artificial Sequence; identical to SEQ ID NO: 237
  Description of Artificial Sequence: Synthetic light chain variable domain

SEQ ID NO: 4404 - protein, 107 aa, Artificial Sequence; identical to SEQ ID NO: 237
  Description of Artificial Sequence: Synthetic light chain variable domain

SEQ ID NO: 4405 - protein, 115 aa, Artificial Sequence; identical to SEQ ID NO: 239
  Description of Artificial Sequence: Synthetic light chain variable domain

SEQ ID NO: 4406 - protein, 107 aa, Artificial Sequence; identical to SEQ ID NO: 237
  Description of Artificial Sequence: Synthetic light chain variable domain

SEQ ID NO: 4407 - protein, 112 aa, Artificial Sequence; identical to SEQ ID NO: 241
  Description of Artificial Sequence: Synthetic light chain variable domain

SEQ ID NO: 4408 - protein, 106 aa, Artificial Sequence; identical to SEQ ID NO: 242
  Description of Artificial Sequence: Synthetic light chain variable domain

SEQ ID NO: 4409 - protein, 106 aa, Artificial Sequence; identical to SEQ ID NO: 243
  Description of Artificial Sequence: Synthetic light chain variable domain

SEQ ID NO: 4410 - protein, 110 aa, Artificial Sequence; identical to SEQ ID NO: 244
  Description of Artificial Sequence: Synthetic light chain variable domain

SEQ ID NO: 4411 - protein, 109 aa, Artificial Sequence; identical to SEQ ID NO: 245
  Description of Artificial Sequence: Synthetic light chain variable domain

SEQ ID NO: 4412 - protein, 108 aa, Artificial Sequence; identical to SEQ ID NO: 246
  Description of Artificial Sequence: Synthetic light chain variable domain

SEQ ID NO: 4413 - protein, 107 aa, Artificial Sequence; identical to SEQ ID NO: 247
  Description of Artificial Sequence: Synthetic light chain variable domain

SEQ ID NO: 4414 - protein, 109 aa, Artificial Sequence; identical to SEQ ID NO: 248
  Description of Artificial Sequence: Synthetic light chain variable domain

SEQ ID NO: 4415 - protein, 109 aa, Artificial Sequence; identical to SEQ ID NO: 249
  Description of Artificial Sequence: Synthetic light chain variable domain

SEQ ID NO: 4416 - protein, 111 aa, Artificial Sequence; identical to SEQ ID NO: 250
  Description of Artificial Sequence: Synthetic light chain variable domain

SEQ ID NO: 4417 - protein, 109 aa, Artificial Sequence; identical to SEQ ID NO: 251
  Description of Artificial Sequence: Synthetic light chain variable domain
  MOD_RES (5)..(6): Any amino acid
  MOD_RES (8)..(9): Any amino acid
  MOD_RES (93)..(93): Any amino acid
  MOD_RES (104)..(104): Any amino acid

SEQ ID NO: 4418 - protein, 112 aa, Artificial Sequence; identical to SEQ ID NO: 252
  Description of Artificial Sequence: Synthetic light chain variable domain
  MOD_RES (61)..(61): Any amino acid

SEQ ID NO: 4419 - protein, 112 aa, Artificial Sequence; identical to SEQ ID NO: 253
  Description of Artificial Sequence: Synthetic light chain variable domain

SEQ ID NO: 4420 - protein, 110 aa, Artificial Sequence; identical to SEQ ID NO: 254
  Description of Artificial Sequence: Synthetic light chain variable domain

SEQ ID NO: 4421 - protein, 112 aa, Artificial Sequence; identical to SEQ ID NO: 255
  Description of Artificial Sequence: Synthetic light chain variable domain

SEQ ID NO: 4422 - protein, 111 aa, Artificial Sequence; identical to SEQ ID NO: 256
  Description of Artificial Sequence: Synthetic light chain variable domain

SEQ ID NO: 4423 - protein, 111 aa, Artificial Sequence; identical to SEQ ID NO: 257
  Description of Artificial Sequence: Synthetic light chain variable domain

SEQ ID NO: 4424 - protein, 106 aa, Artificial Sequence; identical to SEQ ID NO: 258
  Description of Artificial Sequence: Synthetic light chain variable domain

SEQ ID NO: 4425 - protein, 99 aa, Artificial Sequence; identical to SEQ ID NO: 259
  Description of Artificial Sequence: Synthetic light chain variable domain

SEQ ID NO: 4426 - protein, 110 aa, Artificial Sequence; identical to SEQ ID NO: 260
  Description of Artificial Sequence: Synthetic light chain variable domain

SEQ ID NO: 4427 - protein, 111 aa, Artificial Sequence; identical to SEQ ID NO: 261
  Description of Artificial Sequence: Synthetic light chain variable domain

SEQ ID NO: 4428 - protein, 124 aa, Artificial Sequence; identical to SEQ ID NO: 262
  Description of Artificial Sequence: Synthetic light chain variable domain

SEQ ID NO: 4429 - protein, 239 aa, Artificial Sequence; identical to SEQ ID NO: 263
  Description of Artificial Sequence: Synthetic light chain variable domain

SEQ ID NO: 4430 - protein, 111 aa, Artificial Sequence; identical to SEQ ID NO: 264
  Description of Artificial Sequence: Synthetic light chain variable domain

SEQ ID NO: 4431 - protein, 110 aa, Artificial Sequence; identical to SEQ ID NO: 265
  Description of Artificial Sequence: Synthetic light chain variable domain

SEQ ID NO: 4432 - protein, 111 aa, Artificial Sequence; identical to SEQ ID NO: 266
  Description of Artificial Sequence: Synthetic light chain variable domain

SEQ ID NO: 4433 - protein, 109 aa, Artificial Sequence; identical to SEQ ID NO: 267
  Description of Artificial Sequence: Synthetic light chain variable domain

SEQ ID NO: 4434 - protein, 108 aa, Artificial Sequence; identical to SEQ ID NO: 268
  Description of Artificial Sequence: Synthetic light chain variable domain

SEQ ID NO: 4435 - protein, 107 aa, Artificial Sequence; identical to SEQ ID NO: 269
  Description of Artificial Sequence: Synthetic light chain variable domain

SEQ ID NO: 4436 - protein, 109 aa, Artificial Sequence; identical to SEQ ID NO: 270
  Description of Artificial Sequence: Synthetic light chain variable domain

SEQ ID NO: 4437 - protein, 111 aa, Artificial Sequence; identical to SEQ ID NO: 271
  Description of Artificial Sequence: Synthetic light chain variable domain

SEQ ID NO: 4438 - protein, 121 aa, Artificial Sequence; identical to SEQ ID NO: 272
  Description of Artificial Sequence: Synthetic light chain variable domain

SEQ ID NO: 4439 - protein, 119 aa, Artificial Sequence; identical to SEQ ID NO: 749
  Description of Artificial Sequence: Synthetic Antibody variable domain

SEQ ID NO: 4440 - protein, 118 aa, Artificial Sequence; identical to SEQ ID NO: 750
  Description of Artificial Sequence: Synthetic Antibody variable domain

SEQ ID NO: 4441 - protein, 118 aa, Artificial Sequence; identical to SEQ ID NO: 750
  Description of Artificial Sequence: Synthetic Antibody variable domain

SEQ ID NO: 4442 - protein, 120 aa, Artificial Sequence; identical to SEQ ID NO: 752
  Description of Artificial Sequence: Synthetic Antibody variable domain

SEQ ID NO: 4443 - protein, 119 aa, Artificial Sequence; identical to SEQ ID NO: 753
  Description of Artificial Sequence: Synthetic Antibody variable domain

SEQ ID NO: 4444 - protein, 119 aa, Artificial Sequence; identical to SEQ ID NO: 754
  Description of Artificial Sequence: Synthetic Antibody variable domain

SEQ ID NO: 4445 - protein, 117 aa, Artificial Sequence; identical to SEQ ID NO: 755
  Description of Artificial Sequence: Synthetic Antibody variable domain

SEQ ID NO: 4446 - protein, 119 aa, Artificial Sequence; identical to SEQ ID NO: 756
  Description of Artificial Sequence: Synthetic Antibody variable domain

SEQ ID NO: 4447 - protein, 112 aa, Artificial Sequence; identical to SEQ ID NO: 757
  Description of Artificial Sequence: Synthetic Antibody variable domain

SEQ ID NO: 4448 - protein, 111 aa, Artificial Sequence; identical to SEQ ID NO: 758
  Description of Artificial Sequence: Synthetic Antibody variable domain

SEQ ID NO: 4449 - protein, 112 aa, Artificial Sequence; identical to SEQ ID NO: 759
  Description of Artificial Sequence: Synthetic Antibody variable domain

SEQ ID NO: 4450 - protein, 107 aa, Artificial Sequence; identical to SEQ ID NO: 760
  Description of Artificial Sequence: Synthetic Antibody variable domain

SEQ ID NO: 4451 - protein, 112 aa, Artificial Sequence; identical to SEQ ID NO: 761
  Description of Artificial Sequence: Synthetic Antibody variable domain

SEQ ID NO: 4452 - protein, 111 aa, Artificial Sequence; identical to SEQ ID NO: 762
  Description of Artificial Sequence: Synthetic Antibody variable domain

SEQ ID NO: 4453 - protein, 112 aa, Artificial Sequence; identical to SEQ ID NO: 763
  Description of Artificial Sequence: Synthetic Antibody variable domain

SEQ ID NO: 4454 - protein, 107 aa, Artificial Sequence; identical to SEQ ID NO: 764
  Description of Artificial Sequence: Synthetic Antibody variable domain

SEQ ID NO: 4455 - protein, 107 aa, Artificial Sequence; identical to SEQ ID NO: 773
  Description of Artificial Sequence: Synthetic Antibody variable domain

SEQ ID NO: 4456 - protein, 108 aa, Artificial Sequence; identical to SEQ ID NO: 774
  Description of Artificial Sequence: Synthetic Antibody variable domain

SEQ ID NO: 4457 - protein, 124 aa, Artificial Sequence; identical to SEQ ID NO: 775
  Description of Artificial Sequence: Synthetic Antibody variable domain

SEQ ID NO: 4458 - protein, 122 aa, Artificial Sequence; identical to SEQ ID NO: 776
  Description of Artificial Sequence: Synthetic Antibody variable domain

SEQ ID NO: 4459 - protein, 122 aa, Artificial Sequence; identical to SEQ ID NO: 777
  Description of Artificial Sequence: Synthetic Antibody variable domain

SEQ ID NO: 4460 - protein, 120 aa, Mus musculus; identical to SEQ ID NO: 781

SEQ ID NO: 4461 - protein, 119 aa, Artificial Sequence; identical to SEQ ID NO: 782
  Description of Artificial Sequence: Synthetic Antibody variable domain

SEQ ID NO: 4462 - protein, 122 aa, Artificial Sequence; identical to SEQ ID NO: 783
  Description of Artificial Sequence: Synthetic Antibody variable domain

SEQ ID NO: 4463 - protein, 117 aa, Artificial Sequence; identical to SEQ ID NO: 784
  Description of Artificial Sequence: Synthetic Antibody variable domain

SEQ ID NO: 4464 - protein, 107 aa, Mus musculus; identical to SEQ ID NO: 785

SEQ ID NO: 4465 - protein, 109 aa, Artificial Sequence; identical to SEQ ID NO: 786
  Description of Artificial Sequence: Synthetic Antibody variable domain

SEQ ID NO: 4466 - protein, 110 aa, Artificial Sequence; identical to SEQ ID NO: 787
  Description of Artificial Sequence: Synthetic Antibody variable domain

SEQ ID NO: 4467 - protein, 109 aa, Artificial Sequence; identical to SEQ ID NO: 788
  Description of Artificial Sequence: Synthetic Antibody variable domain

SEQ ID NO: 4468 - protein, 449 aa, Artificial Sequence; identical to SEQ ID NO: 793
  Description of Artificial Sequence: Synthetic Antibody variable domain

SEQ ID NO: 4469 - protein, 211 aa, Artificial Sequence; identical to SEQ ID NO: 794
  Description of Artificial Sequence: Synthetic Antibody variable domain

SEQ ID NO: 4470 - protein, 446 aa, Artificial Sequence; identical to SEQ ID NO: 795
  Description of Artificial Sequence: Synthetic Antibody variable domain

SEQ ID NO: 4471 - protein, 448 aa, Artificial Sequence; identical to SEQ ID NO: 796
  Description of Artificial Sequence: Synthetic Antibody variable domain

SEQ ID NO: 4472 - protein, 211 aa, Artificial Sequence; identical to SEQ ID NO: 797
  Description of Artificial Sequence: Synthetic Antibody variable domain

SEQ ID NO: 4473 - protein, 448 aa, Artificial Sequence; identical to SEQ ID NO: 798
  Description of Artificial Sequence: Synthetic Antibody variable domain

SEQ ID NO: 4474 - protein, 211 aa, Artificial Sequence; identical to SEQ ID NO: 799
  Description of Artificial Sequence: Synthetic Antibody variable domain

SEQ ID NO: 4475 - protein, 446 aa, Artificial Sequence; identical to SEQ ID NO: 800
  Description of Artificial Sequence: Synthetic Antibody variable domain

SEQ ID NO: 4476 - protein, 105 aa, Homo sapiens; identical to SEQ ID NO: 801

SEQ ID NO: 4477 - protein, 102 aa, Homo sapiens; identical to SEQ ID NO: 802

SEQ ID NO: 4478 - protein, 449 aa, Artificial Sequence; identical to SEQ ID NO: 793
  Description of Artificial Sequence: Synthetic Antibody variable domain

SEQ ID NO: 4479 - protein, 211 aa, Artificial Sequence; identical to SEQ ID NO: 794
  Description of Artificial Sequence: Synthetic Antibody variable domain

SEQ ID NO: 4480 - protein, 449 aa, Artificial Sequence; identical to SEQ ID NO: 805
  Description of Artificial Sequence: Synthetic Antibody variable domain

SEQ ID NO: 4481 - protein, 211 aa, Artificial Sequence; identical to SEQ ID NO: 806
  Description of Artificial Sequence: Synthetic Antibody variable domain

SEQ ID NO: 4482 - protein, 446 aa, Artificial Sequence; identical to SEQ ID NO: 795
  Description of Artificial Sequence: Synthetic Antibody variable domain

SEQ ID NO: 4483 - protein, 446 aa, Artificial Sequence; identical to SEQ ID NO: 800
  Description of Artificial Sequence: Synthetic Antibody variable domain

SEQ ID NO: 4484 - protein, 119 aa, Artificial Sequence; identical to SEQ ID NO: 809
  Description of Artificial Sequence: Synthetic Antibody variable domain

SEQ ID NO: 4485 - protein, 104 aa, Artificial Sequence; identical to SEQ ID NO: 810
  Description of Artificial Sequence: Synthetic Antibody variable domain

SEQ ID NO: 4486 - protein, 118 aa, Artificial Sequence; identical to SEQ ID NO: 811
  Description of Artificial Sequence: Synthetic Antibody variable domain

SEQ ID NO: 4487 - protein, 118 aa, Artificial Sequence; identical to SEQ ID NO: 812
  Description of Artificial Sequence: Synthetic Antibody variable domain

SEQ ID NO: 4488 - protein, 108 aa, Artificial Sequence; identical to SEQ ID NO: 813
  Description of Artificial Sequence: Synthetic Antibody variable domain

SEQ ID NO: 4489 - protein, 108 aa, Artificial Sequence; identical to SEQ ID NO: 814
  Description of Artificial Sequence: Synthetic Antibody variable domain

SEQ ID NO: 4490 - protein, 113 aa, Artificial Sequence; identical to SEQ ID NO: 815
  Description of Artificial Sequence: Synthetic Antibody variable domain

SEQ ID NO: 4491 - protein, 113 aa, Artificial Sequence; identical to SEQ ID NO: 816
  Description of Artificial Sequence: Synthetic Antibody variable domain

SEQ ID NO: 4492 - protein, 118 aa, Artificial Sequence; identical to SEQ ID NO: 811
  Description of Artificial Sequence: Synthetic Antibody variable domain

SEQ ID NO: 4493 - protein, 118 aa, Artificial Sequence; identical to SEQ ID NO: 812
  Description of Artificial Sequence: Synthetic Antibody variable domain

SEQ ID NO: 4494 - protein, 108 aa, Artificial Sequence; identical to SEQ ID NO: 813
  Description of Artificial Sequence: Synthetic Antibody variable domain

SEQ ID NO: 4495 - protein, 108 aa, Artificial Sequence; identical to SEQ ID NO: 814
  Description of Artificial Sequence: Synthetic Antibody variable domain

SEQ ID NO: 4496 - protein, 240 aa, Artificial Sequence; identical to SEQ ID NO: 821
  Description of Artificial Sequence: Synthetic Antibody variable domain

SEQ ID NO: 4497 - protein, 462 aa, Artificial Sequence; identical to SEQ ID NO: 822
  Description of Artificial Sequence: Synthetic Antibody variable domain

SEQ ID NO: 4498 - protein, 120 aa, Artificial Sequence; identical to SEQ ID NO: 823
  Description of Artificial Sequence: Synthetic Antibody variable domain

SEQ ID NO: 4499 - protein, 112 aa, Artificial Sequence; identical to SEQ ID NO: 824
  Description of Artificial Sequence: Synthetic Antibody variable domain

SEQ ID NO: 4500 - protein, 120 aa, Artificial Sequence; identical to SEQ ID NO: 825
  Description of Artificial Sequence: Synthetic Antibody variable domain

SEQ ID NO: 4501 - protein, 112 aa, Artificial Sequence; identical to SEQ ID NO: 826
  Description of Artificial Sequence: Synthetic Antibody variable domain

SEQ ID NO: 4502 - protein, 119 aa, Artificial Sequence; identical to SEQ ID NO: 827
  Description of Artificial Sequence: Synthetic Antibody variable domain

SEQ ID NO: 4503 - protein, 113 aa, Artificial Sequence; identical to SEQ ID NO: 828
  Description of Artificial Sequence: Synthetic Antibody variable domain

SEQ ID NO: 4504 - protein, 119 aa, Artificial Sequence; identical to SEQ ID NO: 829
  Description of Artificial Sequence: Synthetic Antibody variable domain

SEQ ID NO: 4505 - protein, 113 aa, Artificial Sequence; identical to SEQ ID NO: 830
  Description of Artificial Sequence: Synthetic Antibody variable domain

SEQ ID NO: 4506 - protein, 119 aa, Artificial Sequence; identical to SEQ ID NO: 831
  Description of Artificial Sequence: Synthetic Antibody variable domain

SEQ ID NO: 4507 - protein, 113 aa, Artificial Sequence; identical to SEQ ID NO: 832
  Description of Artificial Sequence: Synthetic Antibody variable domain

SEQ ID NO: 4508 - protein, 119 aa, Artificial Sequence; identical to SEQ ID NO: 833
  Description of Artificial Sequence: Synthetic Antibody variable domain

SEQ ID NO: 4509 - protein, 113 aa, Artificial Sequence; identical to SEQ ID NO: 834
  Description of Artificial Sequence: Synthetic Antibody variable domain

SEQ ID NO: 4510 - protein, 120 aa, Artificial Sequence; identical to SEQ ID NO: 835
  Description of Artificial Sequence: Synthetic Antibody variable domain

SEQ ID NO: 4511 - protein, 112 aa, Artificial Sequence; identical to SEQ ID NO: 836
  Description of Artificial Sequence: Synthetic Antibody variable domain

SEQ ID NO: 4512 - protein, 120 aa, Artificial Sequence; identical to SEQ ID NO: 837
  Description of Artificial Sequence: Synthetic Antibody variable domain

SEQ ID NO: 4513 - protein, 112 aa, Artificial Sequence; identical to SEQ ID NO: 838
  Description of Artificial Sequence: Synthetic Antibody variable domain

SEQ ID NO: 4514 - protein, 121 aa, Artificial Sequence; identical to SEQ ID NO: 839
  Description of Artificial Sequence: Synthetic Antibody variable domain

SEQ ID NO: 4515 - protein, 121 aa, Artificial Sequence; identical to SEQ ID NO: 840
  Description of Artificial Sequence: Synthetic Antibody variable domain

SEQ ID NO: 4516 - protein, 107 aa, Artificial Sequence; identical to SEQ ID NO: 4045
  Description of Artificial Sequence: Synthetic Antibody variable domain

SEQ ID NO: 4517 - protein, 119 aa, Artificial Sequence; identical to SEQ ID NO: 842
  Description of Artificial Sequence: Synthetic Antibody variable domain

SEQ ID NO: 4518 - protein, 113 aa, Artificial Sequence; identical to SEQ ID NO: 843
  Description of Artificial Sequence: Synthetic Antibody variable domain

SEQ ID NO: 4519 - protein, 240 aa, Artificial Sequence; identical to SEQ ID NO: 821
  Description of Artificial Sequence: Synthetic Antibody variable domain

SEQ ID NO: 4520 - protein, 462 aa, Artificial Sequence; identical to SEQ ID NO: 822
  Description of Artificial Sequence: Synthetic Antibody variable domain

SEQ ID NO: 4521 - protein, 239 aa, Artificial Sequence; identical to SEQ ID NO: 846
  Description of Artificial Sequence: Synthetic Antibody variable domain

SEQ ID NO: 4522 - protein, 595 aa, Artificial Sequence; identical to SEQ ID NO: 847
  Description of Artificial Sequence: Synthetic Antibody variable domain

SEQ ID NO: 4523 - protein, 105 aa, Homo sapiens; identical to SEQ ID NO: 801

SEQ ID NO: 4524 - protein, 102 aa, Homo sapiens; identical to SEQ ID NO: 802

SEQ ID NO: 4525 - protein, 569 aa, Homo sapiens; identical to SEQ ID NO: 850

SEQ ID NO: 4526 - protein, 219 aa, Homo sapiens; identical to SEQ ID NO: 851

SEQ ID NO: 4527 - protein, 240 aa, Artificial Sequence; identical to SEQ ID NO: 821
  Description of Artificial Sequence: Synthetic Antibody variable domain

SEQ ID NO: 4528 - protein, 462 aa, Artificial Sequence; identical to SEQ ID NO: 822
  Description of Artificial Sequence: Synthetic Antibody variable domain

SEQ ID NO: 4529 - protein, 113 aa, Artificial Sequence; identical to SEQ ID NO: 816
  Description of Artificial Sequence: Synthetic Antibody variable domain

SEQ ID NO: 4530 - protein, 113 aa, Artificial Sequence; identical to SEQ ID NO: 815
  Description of Artificial Sequence: Synthetic Antibody variable domain

SEQ ID NO: 4531 - protein, 240 aa, Artificial Sequence; identical to SEQ ID NO: 821
  Description of Artificial Sequence: Synthetic Antibody variable domain

SEQ ID NO: 4532 - protein, 462 aa, Artificial Sequence; identical to SEQ ID NO: 822
  Description of Artificial Sequence: Synthetic Antibody variable domain

SEQ ID NO: 4533 - protein, 137 aa, Mus musculus; identical to SEQ ID NO: 858

SEQ ID NO: 4534 - protein, 133 aa, Mus musculus; identical to SEQ ID NO: 859

SEQ ID NO: 4535 - protein, 112 aa, Artificial Sequence; identical to SEQ ID NO: 860
  Description of Artificial Sequence: Synthetic Antibody variable domain

SEQ ID NO: 4536 - protein, 119 aa, Artificial Sequence; identical to SEQ ID NO: 861
  Description of Artificial Sequence: Synthetic Antibody variable domain

SEQ ID NO: 4537 - protein, 112 aa, Mus musculus; identical to SEQ ID NO: 860

SEQ ID NO: 4538 - protein, 119 aa, Mus musculus; identical to SEQ ID NO: 861

SEQ ID NO: 4539 - protein, 112 aa, Mus musculus; identical to SEQ ID NO: 864

SEQ ID NO: 4540 - protein, 119 aa, Mus musculus; identical to SEQ ID NO: 861

SEQ ID NO: 4541 - protein, 112 aa, Artificial Sequence; identical to SEQ ID NO: 860
  Description of Artificial Sequence: Synthetic Antibody variable domain

SEQ ID NO: 4542 - protein, 119 aa, Artificial Sequence; identical to SEQ ID NO: 861
  Description of Artificial Sequence: Synthetic Antibody variable domain

SEQ ID NO: 4543 - protein, 115 aa, Artificial Sequence; identical to SEQ ID NO: 868
  Description of Artificial Sequence: Synthetic Antibody variable domain

SEQ ID NO: 4544 - protein, 108 aa, Artificial Sequence; identical to SEQ ID NO: 869
  Description of Artificial Sequence: Synthetic Antibody variable domain

SEQ ID NO: 4545 - protein, 115 aa, Artificial Sequence; identical to SEQ ID NO: 870
  Description of Artificial Sequence: Synthetic Antibody variable domain

SEQ ID NO: 4546 - protein, 111 aa, Artificial Sequence; identical to SEQ ID NO: 871
  Description of Artificial Sequence: Synthetic Antibody variable domain

SEQ ID NO: 4547 - protein, 115 aa, Artificial Sequence; identical to SEQ ID NO: 901
  Description of Artificial Sequence: Synthetic Antibody variable domain

SEQ ID NO: 4548 - protein, 111 aa, Artificial Sequence; identical to SEQ ID NO: 902
  Description of Artificial Sequence: Synthetic Antibody variable domain

SEQ ID NO: 4549 - protein, 117 aa, Artificial Sequence; identical to SEQ ID NO: 903
  Description of Artificial Sequence: Synthetic Antibody variable domain

SEQ ID NO: 4550 - protein, 228 aa, Artificial Sequence; identical to SEQ ID NO: 904
  Description of Artificial Sequence: Synthetic Antibody variable domain

SEQ ID NO: 4551 - protein, 120 aa, Artificial Sequence; identical to SEQ ID NO: 905
  Description of Artificial Sequence: Synthetic Antibody variable domain

SEQ ID NO: 4552 - protein, 115 aa, Artificial Sequence; identical to SEQ ID NO: 906
  Description of Artificial Sequence: Synthetic Antibody variable domain

SEQ ID NO: 4553 - protein, 118 aa, Artificial Sequence; identical to SEQ ID NO: 907
  Description of Artificial Sequence: Synthetic Antibody variable domain

SEQ ID NO: 4554 - protein, 113 aa, Artificial Sequence; identical to SEQ ID NO: 908
  Description of Artificial Sequence: Synthetic Antibody variable domain

SEQ ID NO: 4555 - protein, 119 aa, Artificial Sequence; identical to SEQ ID NO: 909
  Description of Artificial Sequence: Synthetic Antibody variable domain

SEQ ID NO: 4556 - protein, 112 aa, Artificial Sequence; identical to SEQ ID NO: 910
  Description of Artificial Sequence: Synthetic Antibody variable domain

SEQ ID NO: 4557 - protein, 119 aa, Artificial Sequence; identical to SEQ ID NO: 911
  Description of Artificial Sequence: Synthetic Antibody variable domain

SEQ ID NO: 4558 - protein, 112 aa, Artificial Sequence; identical to SEQ ID NO: 912
  Description of Artificial Sequence: Synthetic Antibody variable domain

SEQ ID NO: 4559 - protein, 117 aa, Artificial Sequence; identical to SEQ ID NO: 913
  Description of Artificial Sequence: Synthetic Antibody variable domain

SEQ ID NO: 4560 - protein, 111 aa, Artificial Sequence; identical to SEQ ID NO: 914
  Description of Artificial Sequence: Synthetic Antibody variable domain

SEQ ID NO: 4561 - protein, 117 aa, Artificial Sequence; identical to SEQ ID NO: 915
  Description of Artificial Sequence: Synthetic Antibody variable domain

SEQ ID NO: 4562 - protein, 111 aa, Artificial Sequence; identical to SEQ ID NO: 916
  Description of Artificial Sequence: Synthetic Antibody variable domain

SEQ ID NO: 4563 - protein, 120 aa, Artificial Sequence [sequence omitted]

SEQ ID NO: 4564 - protein, 107 aa, Artificial Sequence [sequence omitted]

SEQ ID NO: 4565 - protein, 109 aa, Artificial Sequence; identical to SEQ ID NO: 919
  Description of Artificial Sequence: Synthetic Antibody variable domain

SEQ ID NO: 4566 - protein, 120 aa, Artificial Sequence; identical to SEQ ID NO: 920
  Description of Artificial Sequence: Synthetic Antibody variable domain

SEQ ID NO: 4567 - protein, 109 aa, Artificial Sequence; identical to SEQ ID NO: 921
  Description of Artificial Sequence: Synthetic Antibody variable domain

SEQ ID NO: 4568 - protein, 120 aa, Artificial Sequence; identical to SEQ ID NO: 922
  Description of Artificial Sequence: Synthetic Antibody variable domain

SEQ ID NO: 4569 - protein, 109 aa, Artificial Sequence; identical to SEQ ID NO: 923
  Description of Artificial Sequence: Synthetic Antibody variable domain

SEQ ID NO: 4570 - protein, 120 aa, Artificial Sequence; identical to SEQ ID NO: 924
  Description of Artificial Sequence: Synthetic Antibody variable domain

SEQ ID NO: 4571 - protein, 20 aa, Artificial Sequence
  Description of Artificial Sequence: Synthetic Antibody variable domain
EVQLVESGGGLVQPKGSLKL

SEQ ID NO: 4572 - protein, 20 aa, Artificial Sequence
  Description of Artificial Sequence: Synthetic Antibody variable domain
DIVMTQSQKFMSTSVVDRIS

SEQ ID NO: 4573 - protein, 107 aa, Mus musculus; identical to SEQ ID NO: 927

SEQ ID NO: 4574 - protein, 119 aa, Mus musculus; identical to SEQ ID NO: 928

SEQ ID NO: 4575 - protein, 107 aa, Artificial Sequence [sequence omitted]

SEQ ID NO: 4576 - protein, 119 aa, Artificial Sequence [sequence omitted]

SEQ ID NO: 4577 - protein, 107 aa, Artificial Sequence; identical to SEQ ID NO: 931
  Description of Artificial Sequence: Synthetic Antibody variable domain

SEQ ID NO: 4578 - protein, 119 aa, Artificial Sequence; identical to SEQ ID NO: 932
  Description of Artificial Sequence: Synthetic Antibody variable domain

SEQ ID NO: 4579 - protein, 214 aa, Artificial Sequence; identical to SEQ ID NO: 933
  Description of Artificial Sequence: Synthetic Antibody variable domain

SEQ ID NO: 4580 - protein, 448 aa, Artificial Sequence; identical to SEQ ID NO: 934
  Description of Artificial Sequence: Synthetic Antibody variable domain

SEQ ID NO: 4581 - protein, 214 aa, Artificial Sequence; identical to SEQ ID NO: 935
  Description of Artificial Sequence: Synthetic Antibody variable domain

SEQ ID NO: 4582 - protein, 449 aa, Artificial Sequence; identical to SEQ ID NO: 936
  Description of Artificial Sequence: Synthetic Antibody variable domain

SEQ ID NO: 4583 - protein, 217 aa, Artificial Sequence; identical to SEQ ID NO: 937
  Description of Artificial Sequence: Synthetic Antibody variable domain

SEQ ID NO: 4584 - protein, 449 aa, Artificial Sequence; identical to SEQ ID NO: 938
  Description of Artificial Sequence: Synthetic Antibody variable domain

SEQ ID NO: 4585 - protein, 124 aa, Homo sapiens; identical to SEQ ID NO: 939

SEQ ID NO: 4586 - protein, 107 aa, Homo sapiens; identical to SEQ ID NO: 940

SEQ ID NO: 4587 - protein, 122 aa, Homo sapiens; identical to SEQ ID NO: 941

SEQ ID NO: 4588 - protein, 107 aa, Homo sapiens; identical to SEQ ID NO: 942

SEQ ID NO: 4589 - protein, 122 aa, Homo sapiens; identical to SEQ ID NO: 943

SEQ ID NO: 4590 - protein, 108 aa, Homo sapiens; identical to SEQ ID NO: 944

SEQ ID NO: 4591 - protein, 109 aa, Artificial Sequence; identical to SEQ ID NO: 945
  Description of Artificial Sequence: Synthetic Antibody variable domain

SEQ ID NO: 4592 - protein, 109 aa, Artificial Sequence; identical to SEQ ID NO: 946
  Description of Artificial Sequence: Synthetic Antibody variable domain

SEQ ID NO: 4593 - protein, 109 aa, Artificial Sequence; identical to SEQ ID NO: 947
  Description of Artificial Sequence: Synthetic Antibody variable domain

SEQ ID NO: 4594 - protein, 228 aa, Artificial Sequence; identical to SEQ ID NO: 948
  Description of Artificial Sequence: Synthetic Antibody variable domain

SEQ ID NO: 4595 - protein, 109 aa, Homo sapiens; identical to SEQ ID NO: 949

SEQ ID NO: 4596 - protein, 142 aa, Artificial Sequence; identical to SEQ ID NO: 950
  Description of Artificial Sequence: Synthetic Antibody variable domain

SEQ ID NO: 4597 - protein, 130 aa, Artificial Sequence; identical to SEQ ID NO: 951
  Description of Artificial Sequence: Synthetic Antibody variable domain

SEQ ID NO: 4598 - protein, 472 aa, Artificial Sequence; identical to SEQ ID NO: 952
  Description of Artificial Sequence: Synthetic Antibody variable domain

SEQ ID NO: 4599 - protein, 236 aa, Artificial Sequence; identical to SEQ ID NO: 953
  Description of Artificial Sequence: Synthetic Antibody variable domain

SEQ ID NO: 4600 - protein, 628 aa, Artificial Sequence; identical to SEQ ID NO: 954
  Description of Artificial Sequence: Synthetic Antibody variable domain

SEQ ID NO: 4601 - protein, 643 aa, Artificial Sequence; identical to SEQ ID NO: 955
  Description of Artificial Sequence: Synthetic Antibody variable domain

SEQ ID NO: 4602 - protein, 214 aa, Mus musculus; identical to SEQ ID NO: 956

SEQ ID NO: 4603 - protein, 220 aa, Mus musculus; identical to SEQ ID NO: 957

SEQ ID NO: 4604 - protein, 233 aa, Artificial Sequence; identical to SEQ ID NO: 958
  Description of Artificial Sequence: Synthetic Antibody variable domain

SEQ ID NO: 4605 - protein, 467 aa, Artificial Sequence; identical to SEQ ID NO: 959
  Description of Artificial Sequence: Synthetic Antibody variable domain

SEQ ID NO: 4606 - protein, 219 aa, Artificial Sequence; identical to SEQ ID NO: 960
  Description of Artificial Sequence: Synthetic Antibody variable domain

SEQ ID NO: 4607 - protein, 234 aa, Artificial Sequence; identical to SEQ ID NO: 961
  Description of Artificial Sequence: Synthetic Antibody variable domain

SEQ ID NO: 4608 - protein, 450 aa, Artificial Sequence; identical to SEQ ID NO: 962
  Description of Artificial Sequence: Synthetic Antibody variable domain

SEQ ID NO: 4609 - protein, 450 aa, Artificial Sequence; identical to SEQ ID NO: 963
  Description of Artificial Sequence: Synthetic Antibody variable domain

SEQ ID NO: 4610 - protein, 214 aa, Artificial Sequence; identical to SEQ ID NO: 964
  Description of Artificial Sequence: Synthetic Antibody variable domain

SEQ ID NO: 4611 - protein, 129 aa, Artificial Sequence; identical to SEQ ID NO: 965
  Description of Artificial Sequence: Synthetic Antibody variable domain

SEQ ID NO: 4612 - protein, 111 aa, Artificial Sequence; identical to SEQ ID NO: 966
  Description of Artificial Sequence: Synthetic Antibody variable domain

SEQ ID NO: 4613 - protein, 121 aa, Artificial Sequence; identical to SEQ ID NO: 967
  Description of Artificial Sequence: Synthetic Antibody variable domain

SEQ ID NO: 4614 - protein, 107 aa, Artificial Sequence; identical to SEQ ID NO: 968
  Description of Artificial Sequence: Synthetic Antibody variable domain

SEQ ID NO: 4615 - protein, 451 aa, Artificial Sequence; identical to SEQ ID NO: 969
  Description of Artificial Sequence: Synthetic Antibody variable domain

SEQ ID NO: 4616 - protein, 469 aa, Artificial Sequence; identical to SEQ ID NO: 970
  Description of Artificial Sequence: Synthetic Antibody variable domain

SEQ ID NO: 4617 - protein, 233 aa, Artificial Sequence; identical to SEQ ID NO: 971
  Description of Artificial Sequence: Synthetic Antibody variable domain

SEQ ID NO: 4618 - protein, 450 aa, Artificial Sequence; identical to SEQ ID NO: 972
  Description of Artificial Sequence: Synthetic Antibody variable domain

SEQ ID NO: 4619 - DNA, 726 bp, Artificial Sequence; identical to SEQ ID NO: 1295
  Description of Artificial Sequence: Synthetic CD19 scFv

SEQ ID NO: 4620 - DNA, 726 bp, Artificial Sequence; identical to SEQ ID NO: 1296
  Description of Artificial Sequence: Synthetic CD19 scFv

SEQ ID NO: 4621 - DNA, 726 bp, Artificial Sequence; identical to SEQ ID NO: 1297
  Description of Artificial Sequence: Synthetic CD19 scFv

SEQ ID NO: 4622 - DNA, 726 bp, Artificial Sequence; identical to SEQ ID NO: 1298
  Description of Artificial Sequence: Synthetic CD19 scFv

SEQ ID NO: 4623 - DNA, 726 bp, Artificial Sequence; identical to SEQ ID NO: 1299
  Description of Artificial Sequence: Synthetic CD19 scFv

SEQ ID NO: 4624 - DNA, 207 bp, Homo sapiens; identical to SEQ ID NO: 1301

SEQ ID NO: 4625 - DNA, 135 bp, Artificial Sequence; identical to SEQ ID NO: 1303
  Description of Artificial Sequence: Synthetic Construct

SEQ ID NO: 4626 - DNA, 135 bp, Artificial Sequence; identical to SEQ ID NO: 1304
  Description of Artificial Sequence: Synthetic Construct

SEQ ID NO: 4627 - DNA, 135 bp, Artificial Sequence; identical to SEQ ID NO: 1305
  Description of Artificial Sequence: Synthetic Construct

SEQ ID NO: 4628 - DNA, 135 bp, Artificial Sequence; identical to SEQ ID NO: 1306
  Description of Artificial Sequence: Synthetic Construct

SEQ ID NO: 4629 - DNA, 135 bp, Artificial Sequence; identical to SEQ ID NO: 1307
  Description of Artificial Sequence: Synthetic Construct

SEQ ID NO: 4630 - DNA, 338 bp, Artificial Sequence; identical to SEQ ID NO: 1309
  Description of Artificial Sequence: Synthetic Construct

SEQ ID NO: 4631 - DNA, 338 bp, Artificial Sequence; identical to SEQ ID NO: 1310
  Description of Artificial Sequence: Synthetic Construct

SEQ ID NO: 4632 - DNA, 338 bp, Artificial Sequence; identical to SEQ ID NO: 1311
  Description of Artificial Sequence: Synthetic Construct

SEQ ID NO: 4633 - DNA, 338 bp, Artificial Sequence; identical to SEQ ID NO: 1312
  Description of Artificial Sequence: Synthetic Construct

SEQ ID NO: 4634 - DNA, 338 bp, Artificial Sequence; identical to SEQ ID NO: 1313
  Description of Artificial Sequence: Synthetic Construct

SEQ ID NO: 4635 - DNA, 126 bp, Artificial Sequence; identical to SEQ ID NO: 1315
  Description of Artificial Sequence: Synthetic Construct

SEQ ID NO: 4636 - DNA, 126 bp, Artificial Sequence; identical to SEQ ID NO: 1316
  Description of Artificial Sequence: Synthetic Construct

SEQ ID NO: 4637 - DNA, 126 bp, Artificial Sequence; identical to SEQ ID NO: 1317
  Description of Artificial Sequence: Synthetic Construct

SEQ ID NO: 4638 - DNA, 126 bp, Artificial Sequence; identical to SEQ ID NO: 1318
  Description of Artificial Sequence: Synthetic Construct

SEQ ID NO: 4639 - DNA, 126 bp, Artificial Sequence; identical to SEQ ID NO: 1319
  Description of Artificial Sequence: Synthetic Construct

SEQ ID NO: 4640 - DNA, 63 bp, Homo sapiens; identical to SEQ ID NO: 1321

SEQ ID NO: 4641 - DNA, 63 bp, Artificial Sequence; identical to SEQ ID NO: 1322
  Description of Artificial Sequence: Synthetic Signal Sequence

SEQ ID NO: 4642 - DNA, 63 bp, Artificial Sequence; identical to SEQ ID NO: 1323
  Description of Artificial Sequence: Synthetic Signal Sequence

SEQ ID NO: 4643 - DNA, 63 bp, Artificial Sequence; identical to SEQ ID NO: 1324
  Description of Artificial Sequence: Synthetic Signal Sequence

SEQ ID NO: 4644 - DNA, 63 bp, Artificial Sequence; identical to SEQ ID NO: 1325
  Description of Artificial Sequence: Synthetic Signal Sequence

SEQ ID NO: 4645 - DNA, 63 bp, Artificial Sequence; identical to SEQ ID NO: 1326
  Description of Artificial Sequence: Synthetic Signal Sequence

SEQ ID NO: 4646 - DNA, 63 bp, Artificial Sequence; identical to SEQ ID NO: 1327
  Description of Artificial Sequence: Synthetic Signal Sequence

SEQ ID NO: 4647 - DNA, 63 bp, Artificial Sequence; identical to SEQ ID NO: 1328
  Description of Artificial Sequence: Synthetic Signal Sequence

SEQ ID NO: 4648 - DNA, 15 bp, Artificial Sequence
  Description of Artificial Sequence: Synthetic Linker
ggaggctctggagga

SEQ ID NO: 4649 - DNA, 15 bp, Artificial Sequence
  Description of Artificial Sequence: Synthetic Linker
ggaggctccggcgga

SEQ ID NO: 4650 - DNA, 15 bp, Artificial Sequence
  Description of Artificial Sequence: Synthetic Linker
ggaggatccggaggc

SEQ ID NO: 4651 - DNA, 15 bp, Artificial Sequence
  Description of Artificial Sequence: Synthetic Linker
ggaggatctggagga

SEQ ID NO: 4652 - DNA, 36 bp, Artificial Sequence; identical to SEQ ID NO: 1337
  Description of Artificial Sequence: Synthetic Cleavage site

SEQ ID NO: 4653 - DNA, 36 bp, Artificial Sequence; identical to SEQ ID NO: 1338
  Description of Artificial Sequence: Synthetic Cleavage site

SEQ ID NO: 4654 - DNA, 36 bp, Artificial Sequence; identical to SEQ ID NO: 1339
  Description of Artificial Sequence: Synthetic Cleavage site

SEQ ID NO: 4655 - DNA, 561 bp, Artificial Sequence; identical to SEQ ID NO: 73
  Description of Artificial Sequence: Synthetic Destabilizing Domain (DD)

SEQ ID NO: 4656 - DNA, 561 bp, Artificial Sequence; identical to SEQ ID NO: 77
  Description of Artificial Sequence: Synthetic Destabilizing Domain (DD)

SEQ ID NO: 4657 - DNA, 561 bp, Artificial Sequence; identical to SEQ ID NO: 83
  Description of Artificial Sequence: Synthetic Destabilizing Domain (DD)

SEQ ID NO: 4658 - DNA, 561 bp, Artificial Sequence; identical to SEQ ID NO: 85
  Description of Artificial Sequence: Synthetic Destabilizing Domain (DD)

SEQ ID NO: 4659 - DNA, 2034 bp, Artificial Sequence; identical to SEQ ID NO: 165
  Description of Artificial Sequence: Synthetic Construct

SEQ ID NO: 4660 - DNA, 2034 bp, Artificial Sequence; identical to SEQ ID NO: 166
  Description of Artificial Sequence: Synthetic Construct

SEQ ID NO: 4661 - DNA, 2034 bp, Artificial Sequence; identical to SEQ ID NO: 167
  Description of Artificial Sequence: Synthetic Construct

SEQ ID NO: 4662 - DNA, 2034 bp, Artificial Sequence; identical to SEQ ID NO: 1707
  Description of Artificial Sequence: Synthetic Construct

SEQ ID NO: 4663 - DNA, 2062 bp, Artificial Sequence; identical to SEQ ID NO: 174
  Description of Artificial Sequence: Synthetic Construct

SEQ ID NO: 4664 - DNA, 2061 bp, Artificial Sequence; identical to SEQ ID NO: 176
  Description of Artificial Sequence: Synthetic Construct

SEQ ID NO: 4665 - DNA, 2062 bp, Artificial Sequence; identical to SEQ ID NO: 175
  Description of Artificial Sequence: Synthetic Construct

SEQ ID NO: 4666 - DNA, 2061 bp, Artificial Sequence; identical to SEQ ID NO: 177
  Description of Artificial Sequence: Synthetic Construct

SEQ ID NO: 4667 - protein, 263 aa, Artificial Sequence; identical to SEQ ID NO: 273
  Description of Artificial Sequence: Synthetic single chain variable fragment

SEQ ID NO: 4668 - protein, 247 aa, Artificial Sequence; identical to SEQ ID NO: 274
  Description of Artificial Sequence: Synthetic single chain variable fragment

SEQ ID NO: 4669 - protein, 242 aa, Artificial Sequence; identical to SEQ ID NO: 275
  Description of Artificial Sequence: Synthetic single chain variable fragment

SEQ ID NO: 4670 - protein, 247 aa, Artificial Sequence; identical to SEQ ID NO: 276
  Description of Artificial Sequence: Synthetic single chain variable fragment

SEQ ID NO: 4671 - protein, 248 aa, Artificial Sequence; identical to SEQ ID NO: 277
  Description of Artificial Sequence: Synthetic single chain variable fragment

SEQ ID NO: 4672 - protein, 242 aa, Artificial Sequence; identical to SEQ ID NO: 278
  Description of Artificial Sequence: Synthetic single chain variable fragment

SEQ ID NO: 4673 - protein, 242 aa, Artificial Sequence; identical to SEQ ID NO: 279
  Description of Artificial Sequence: Synthetic single chain variable fragment

SEQ ID NO: 4674 - protein, 242 aa, Artificial Sequence; identical to SEQ ID NO: 280
  Description of Artificial Sequence: Synthetic single chain variable fragment

SEQ ID NO: 4675 - protein, 246 aa, Artificial Sequence; identical to SEQ ID NO: 281
  Description of Artificial Sequence: Synthetic single chain variable fragment

SEQ ID NO: 4676 - protein, 252 aa, Artificial Sequence; identical to SEQ ID NO: 282
  Description of Artificial Sequence: Synthetic single chain variable fragment

SEQ ID NO: 4677 - protein, 249 aa, Artificial Sequence; identical to SEQ ID NO: 283
  Description of Artificial Sequence: Synthetic single chain variable fragment

SEQ ID NO: 4678 - protein, 249 aa, Artificial Sequence; identical to SEQ ID NO: 284
  Description of Artificial Sequence: Synthetic single chain variable fragment

SEQ ID NO: 4679 - protein, 251 aa, Artificial Sequence; identical to SEQ ID NO: 285
  Description of Artificial Sequence: Synthetic single chain variable fragment

SEQ ID NO: 4680 - protein, 252 aa, Artificial Sequence; identical to SEQ ID NO: 286
  Description of Artificial Sequence: Synthetic single chain variable fragment

SEQ ID NO: 4681 - protein, 252 aa, Artificial Sequence; identical to SEQ ID NO: 286
  Description of Artificial Sequence: Synthetic single chain variable fragment

SEQ ID NO: 4682 - protein, 252 aa, Artificial Sequence; identical to SEQ ID NO: 288
  Description of Artificial Sequence: Synthetic single chain variable fragment

SEQ ID NO: 4683 - protein, 252 aa, Artificial Sequence; identical to SEQ ID NO: 288
  Description of Artificial Sequence: Synthetic single chain variable fragment

SEQ ID NO: 4684 - protein, 252 aa, Artificial Sequence; identical to SEQ ID NO: 288
  Description of Artificial Sequence: Synthetic single chain variable fragment

SEQ ID NO: 4685 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 4686 - protein, 252 aa, Artificial Sequence; identical to SEQ ID NO: 286
  Description of Artificial Sequence: Synthetic single chain variable fragment

SEQ ID NO: 4687 - protein, 250 aa, Artificial Sequence; identical to SEQ ID NO: 293
  Description of Artificial Sequence: Synthetic single chain variable fragment

SEQ ID NO: 4688 - protein, 252 aa, Artificial Sequence; identical to SEQ ID NO: 294
  Description of Artificial Sequence: Synthetic single chain variable fragment

SEQ ID NO: 4689 - protein, 236 aa, Artificial Sequence; identical to SEQ ID NO: 295
  Description of Artificial Sequence: Synthetic single chain variable fragment

SEQ ID NO: 4690 - protein, 251 aa, Artificial Sequence; identical to SEQ ID NO: 296
  Description of Artificial Sequence: Synthetic single chain variable fragment

SEQ ID NO: 4691 - protein, 246 aa, Artificial Sequence; identical to SEQ ID NO: 297
  Description of Artificial Sequence: Synthetic single chain variable fragment

SEQ ID NO: 4692 - protein, 239 aa, Artificial Sequence; identical to SEQ ID NO: 298
  Description of Artificial Sequence: Synthetic single chain variable fragment

SEQ ID NO: 4693 - protein, 250 aa, Artificial Sequence; identical to SEQ ID NO: 299
  Description of Artificial Sequence: Synthetic single chain variable fragment

SEQ ID NO: 4694 - protein, 251 aa, Artificial Sequence; identical to SEQ ID NO: 300
  Description of Artificial Sequence: Synthetic single chain variable fragment

SEQ ID NO: 4695 - protein, 242 aa, Artificial Sequence; identical to SEQ ID NO: 301
  Description of Artificial Sequence: Synthetic single chain variable fragment

SEQ ID NO: 4696 - protein, 242 aa, Artificial Sequence; identical to SEQ ID NO: 302
  Description of Artificial Sequence: Synthetic single chain variable fragment

SEQ ID NO: 4697 - protein, 246 aa, Artificial Sequence; identical to SEQ ID NO: 303
  Description of Artificial Sequence: Synthetic single chain variable fragment

SEQ ID NO: 4698 - protein, 249 aa, Artificial Sequence; identical to SEQ ID NO: 304
  Description of Artificial Sequence: Synthetic single chain variable fragment

SEQ ID NO: 4699 - protein, 249 aa, Artificial Sequence; identical to SEQ ID NO: 305
  Description of Artificial Sequence: Synthetic single chain variable fragment

SEQ ID NO: 4700 - protein, 252 aa, Artificial Sequence; identical to SEQ ID NO: 288
  Description of Artificial Sequence: Synthetic single chain variable fragment

SEQ ID NO: 4701 - protein, 495 aa, Artificial Sequence; identical to SEQ ID NO: 307
  Description of Artificial Sequence: Synthetic single chain variable fragment

SEQ ID NO: 4702 - protein, 247 aa, Artificial Sequence; identical to SEQ ID NO: 308
  Description of Artificial Sequence: Synthetic single chain variable fragment

SEQ ID NO: 4703 - protein, 251 aa, Artificial Sequence; identical to SEQ ID NO: 309
  Description of Artificial Sequence: Synthetic single chain variable fragment

SEQ ID NO: 4704 - protein, 250 aa, Artificial Sequence; identical to SEQ ID NO: 310
  Description of Artificial Sequence: Synthetic single chain variable fragment

SEQ ID NO: 4705 - protein, 247 aa, Artificial Sequence; identical to SEQ ID NO: 311
  Description of Artificial Sequence: Synthetic single chain variable fragment

SEQ ID NO: 4706 - protein, 248 aa, Artificial Sequence; identical to SEQ ID NO: 312
  Description of Artificial Sequence: Synthetic single chain variable fragment

SEQ ID NO: 4707 - protein, 242 aa, Artificial Sequence; identical to SEQ ID NO: 313
  Description of Artificial Sequence: Synthetic single chain variable fragment

SEQ ID NO: 4708 - protein, 251 aa, Artificial Sequence; identical to SEQ ID NO: 314
  Description of Artificial Sequence: Synthetic single chain variable fragment

SEQ ID NO: 4709 - protein, 247 aa, Artificial Sequence; identical to SEQ ID NO: 315
  Description of Artificial Sequence: Synthetic single chain variable fragment

SEQ ID NO: 4710 - protein, 250 aa, Artificial Sequence; identical to SEQ ID NO: 316
  Description of Artificial Sequence: Synthetic single chain variable fragment

SEQ ID NO: 4711 - protein, 252 aa, Artificial Sequence; identical to SEQ ID NO: 317
  Description of Artificial Sequence: Synthetic single chain variable fragment

SEQ ID NO: 4712 - protein, 247 aa, Artificial Sequence; identical to SEQ ID NO: 318
  Description of Artificial Sequence: Synthetic single chain variable fragment

SEQ ID NO: 4713 - protein, 247 aa, Artificial Sequence; identical to SEQ ID NO: 319
  Description of Artificial Sequence: Synthetic single chain variable fragment

SEQ ID NO: 4714 - protein, 249 aa, Artificial Sequence; identical to SEQ ID NO: 320
  Description of Artificial Sequence: Synthetic single chain variable fragment

SEQ ID NO: 4715 - protein, 251 aa, Artificial Sequence; identical to SEQ ID NO: 321
  Description of Artificial Sequence: Synthetic single chain variable fragment

SEQ ID NO: 4716 - protein, 247 aa, Artificial Sequence; identical to SEQ ID NO: 322
  Description of Artificial Sequence: Synthetic single chain variable fragment

SEQ ID NO: 4717 - protein, 241 aa, Artificial Sequence; identical to SEQ ID NO: 323
  Description of Artificial Sequence: Synthetic single chain variable fragment

SEQ ID NO: 4718 - protein, 248 aa, Artificial Sequence; identical to SEQ ID NO: 277
  Description of Artificial Sequence: Synthetic single chain variable fragment

SEQ ID NO: 4719 - protein, 246 aa, Artificial Sequence; identical to SEQ ID NO: 281
  Description of Artificial Sequence: Synthetic single chain variable fragment

SEQ ID NO: 4720 - protein, 252 aa, Artificial Sequence; identical to SEQ ID NO: 282
  Description of Artificial Sequence: Synthetic single chain variable fragment

SEQ ID NO: 4721 - protein, 249 aa, Artificial Sequence; identical to SEQ ID NO: 283
  Description of Artificial Sequence: Synthetic single chain variable fragment

SEQ ID NO: 4722 - protein, 249 aa, Artificial Sequence; identical to SEQ ID NO: 284
  Description of Artificial Sequence: Synthetic single chain variable fragment

SEQ ID NO: 4723 - protein, 251 aa, Artificial Sequence; identical to SEQ ID NO: 285
  Description of Artificial Sequence: Synthetic single chain variable fragment

SEQ ID NO: 4724 - protein, 252 aa, Artificial Sequence; identical to SEQ ID NO: 286
  Description of Artificial Sequence: Synthetic single chain variable fragment

SEQ ID NO: 4725 - protein, 252 aa, Artificial Sequence; identical to SEQ ID NO: 286
  Description of Artificial Sequence: Synthetic single chain variable fragment

SEQ ID NO: 4726 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 4727 - protein, 252 aa, Artificial Sequence; identical to SEQ ID NO: 288
  Description of Artificial Sequence: Synthetic single chain variable fragment

SEQ ID NO: 4728 - protein, 252 aa, Artificial Sequence; identical to SEQ ID NO: 288
  Description of Artificial Sequence: Synthetic single chain variable fragment

SEQ ID NO: 4729 - protein, 252 aa, Artificial Sequence; identical to SEQ ID NO: 288
  Description of Artificial Sequence: Synthetic single chain variable fragment

SEQ ID NO: 4730 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 4731 - protein, 252 aa, Artificial Sequence; identical to SEQ ID NO: 286
  Description of Artificial Sequence: Synthetic single chain variable fragment

SEQ ID NO: 4732 - protein, 250 aa, Artificial Sequence; identical to SEQ ID NO: 293
  Description of Artificial Sequence: Synthetic single chain variable fragment

SEQ ID NO: 4733 - protein, 252 aa, Artificial Sequence; identical to SEQ ID NO: 294
  Description of Artificial Sequence: Synthetic single chain variable fragment

SEQ ID NO: 4734 - protein, 236 aa, Artificial Sequence; identical to SEQ ID NO: 295
  Description of Artificial Sequence: Synthetic single chain variable fragment

SEQ ID NO: 4735 - protein, 251 aa, Artificial Sequence; identical to SEQ ID NO: 296
  Description of Artificial Sequence: Synthetic single chain variable fragment

SEQ ID NO: 4736 - protein, 246 aa, Artificial Sequence; identical to SEQ ID NO: 297
  Description of Artificial Sequence: Synthetic single chain variable fragment

SEQ ID NO: 4737 - protein, 239 aa, Artificial Sequence; identical to SEQ ID NO: 298
  Description of Artificial Sequence: Synthetic single chain variable fragment

SEQ ID NO: 4738 - protein, 250 aa, Artificial Sequence; identical to SEQ ID NO: 299
  Description of Artificial Sequence: Synthetic single chain variable fragment

SEQ ID NO: 4739 - protein, 251 aa, Artificial Sequence; identical to SEQ ID NO: 300
  Description of Artificial Sequence: Synthetic single chain variable fragment

SEQ ID NO: 4740 - protein, 273 aa, Artificial Sequence; identical to SEQ ID NO: 346
  Description of Artificial Sequence: Synthetic single chain variable fragment

SEQ ID NO: 4741 - protein, 270 aa, Artificial Sequence; identical to SEQ ID NO: 347
  Description of Artificial Sequence: Synthetic single chain variable fragment

SEQ ID NO: 4742 - protein, 277 aa, Artificial Sequence; identical to SEQ ID NO: 348
  Description of Artificial Sequence: Synthetic single chain variable fragment

SEQ ID NO: 4743 - protein, 246 aa, Artificial Sequence; identical to SEQ ID NO: 303
  Description of Artificial Sequence: Synthetic single chain variable fragment

SEQ ID NO: 4744 - protein, 249 aa, Artificial Sequence; identical to SEQ ID NO: 304
  Description of Artificial Sequence: Synthetic single chain variable fragment

SEQ ID NO: 4745 - protein, 249 aa, Artificial Sequence; identical to SEQ ID NO: 305
  Description of Artificial Sequence: Synthetic single chain variable fragment

SEQ ID NO: 4746 - protein, 252 aa, Artificial Sequence; identical to SEQ ID NO: 288
  Description of Artificial Sequence: Synthetic single chain variable fragment

SEQ ID NO: 4747 - protein, 251 aa, Artificial Sequence; identical to SEQ ID NO: 309
  Description of Artificial Sequence: Synthetic single chain variable fragment

SEQ ID NO: 4748 - protein, 250 aa, Artificial Sequence; identical to SEQ ID NO: 310
  Description of Artificial Sequence: Synthetic single chain variable fragment

SEQ ID NO: 4749 - protein, 247 aa, Artificial Sequence; identical to SEQ ID NO: 311
  Description of Artificial Sequence: Synthetic single chain variable fragment

SEQ ID NO: 4750 - protein, 248 aa, Artificial Sequence; identical to SEQ ID NO: 312
  Description of Artificial Sequence: Synthetic single chain variable fragment

SEQ ID NO: 4751 - protein, 251 aa, Artificial Sequence; identical to SEQ ID NO: 314
  Description of Artificial Sequence: Synthetic single chain variable fragment

SEQ ID NO: 4752 - protein, 250 aa, Artificial Sequence; identical to SEQ ID NO: 316
  Description of Artificial Sequence: Synthetic single chain variable fragment

SEQ ID NO: 4753 - protein, 249 aa, Artificial Sequence; identical to SEQ ID NO: 320
  Description of Artificial Sequence: Synthetic single chain variable fragment

SEQ ID NO: 4754 - protein, 251 aa, Artificial Sequence; identical to SEQ ID NO: 321
  Description of Artificial Sequence: Synthetic single chain variable fragment

SEQ ID NO: 4755 - protein, 249 aa, Artificial Sequence; identical to SEQ ID NO: 284
  Description of Artificial Sequence: Synthetic single chain variable fragment

SEQ ID NO: 4756 - protein, 242 aa, Artificial Sequence; identical to SEQ ID NO: 275
  Description of Artificial Sequence: Synthetic single chain variable fragment

SEQ ID NO: 4757 - protein, 245 aa, Artificial Sequence; identical to SEQ ID NO: 363
  Description of Artificial Sequence: Synthetic single chain variable fragment

SEQ ID NO: 4758 - protein, 119 aa, Artificial Sequence; identical to SEQ ID NO: 364
  Description of Artificial Sequence: Synthetic single chain variable fragment

SEQ ID NO: 4759 - protein, 438 aa, Artificial Sequence; identical to SEQ ID NO: 365
  Description of Artificial Sequence: Synthetic single chain variable fragment

SEQ ID NO: 4760 - protein, 272 aa, Artificial Sequence; identical to SEQ ID NO: 366
  Description of Artificial Sequence: Synthetic single chain variable fragment

SEQ ID NO: 4761 - protein, 267 aa, Artificial Sequence; identical to SEQ ID NO: 367
  Description of Artificial Sequence: Synthetic single chain variable fragment

SEQ ID NO: 4762 - protein, 270 aa, Artificial Sequence; identical to SEQ ID NO: 347
  Description of Artificial Sequence: Synthetic single chain variable fragment

SEQ ID NO: 4763 - protein, 277 aa, Artificial Sequence; identical to SEQ ID NO: 348
  Description of Artificial Sequence: Synthetic single chain variable fragment

SEQ ID NO: 4764 - protein, 242 aa, Artificial Sequence; identical to SEQ ID NO: 280
  Description of Artificial Sequence: Synthetic single chain variable fragment

SEQ ID NO: 4765 - protein, 242 aa, Artificial Sequence; identical to SEQ ID NO: 301
  Description of Artificial Sequence: Synthetic single chain variable fragment

SEQ ID NO: 4766 - protein, 242 aa, Artificial Sequence; identical to SEQ ID NO: 302
  Description of Artificial Sequence: Synthetic single chain variable fragment

SEQ ID NO: 4767 - protein, 247 aa, Artificial Sequence; identical to SEQ ID NO: 308
  Description of Artificial Sequence: Synthetic single chain variable fragment

SEQ ID NO: 4768 - protein, 247 aa, Artificial Sequence; identical to SEQ ID NO: 315
  Description of Artificial Sequence: Synthetic single chain variable fragment

SEQ ID NO: 4769 - protein, 247 aa, Artificial Sequence; identical to SEQ ID NO: 318
  Description of Artificial Sequence: Synthetic single chain variable fragment

SEQ ID NO: 4770 - protein, 247 aa, Artificial Sequence; identical to SEQ ID NO: 319
  Description of Artificial Sequence: Synthetic single chain variable fragment

SEQ ID NO: 4771 - protein, 247 aa, Artificial Sequence; identical to SEQ ID NO: 322
  Description of Artificial Sequence: Synthetic single chain variable fragment

SEQ ID NO: 4772 - protein, 247 aa, Artificial Sequence; identical to SEQ ID NO: 276
  Description of Artificial Sequence: Synthetic single chain variable fragment

SEQ ID NO: 4773 - protein, 242 aa, Artificial Sequence; identical to SEQ ID NO: 278
  Description of Artificial Sequence: Synthetic single chain variable fragment

SEQ ID NO: 4774 - protein, 495 aa, Artificial Sequence; identical to SEQ ID NO: 307
  Description of Artificial Sequence: Synthetic single chain variable fragment

SEQ ID NO: 4775 - protein, 242 aa, Artificial Sequence; identical to SEQ ID NO: 279
  Description of Artificial Sequence: Synthetic single chain variable fragment

SEQ ID NO: 4776 - protein, 242 aa, Artificial Sequence; identical to SEQ ID NO: 313
  Description of Artificial Sequence: Synthetic single chain variable fragment

SEQ ID NO: 4777 - protein, 252 aa, Artificial Sequence; identical to SEQ ID NO: 317
  Description of Artificial Sequence: Synthetic single chain variable fragment

SEQ ID NO: 4778 - protein, 250 aa, Artificial Sequence; identical to SEQ ID NO: 384
  Description of Artificial Sequence: Synthetic single chain variable fragment

SEQ ID NO: 4779 - protein, 242 aa, Artificial Sequence; identical to SEQ ID NO: 313
  Description of Artificial Sequence: Synthetic single chain variable fragment

SEQ ID NO: 4780 - protein, 251 aa, Artificial Sequence; identical to SEQ ID NO: 386
  Description of Artificial Sequence: Synthetic single chain variable fragment

SEQ ID NO: 4781 - protein, 271 aa, Artificial Sequence; identical to SEQ ID NO: 387
  Description of Artificial Sequence: Synthetic single chain variable fragment

SEQ ID NO: 4782 - protein, 248 aa, Artificial Sequence; identical to SEQ ID NO: 277
  Description of Artificial Sequence: Synthetic single chain variable fragment

SEQ ID NO: 4783 - protein, 246 aa, Artificial Sequence; identical to SEQ ID NO: 281
  Description of Artificial Sequence: Synthetic single chain variable fragment

SEQ ID NO: 4784 - protein, 252 aa, Artificial Sequence; identical to SEQ ID NO: 282
  Description of Artificial Sequence: Synthetic single chain variable fragment

SEQ ID NO: 4785 - protein, 249 aa, Artificial Sequence; identical to SEQ ID NO: 283
  Description of Artificial Sequence: Synthetic single chain variable fragment

SEQ ID NO: 4786 - protein, 251 aa, Artificial Sequence; identical to SEQ ID NO: 285
  Description of Artificial Sequence: Synthetic single chain variable fragment

SEQ ID NO: 4787 - protein, 252 aa, Artificial Sequence; identical to SEQ ID NO: 286
  Description of Artificial Sequence: Synthetic single chain variable fragment

SEQ ID NO: 4788 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 4789 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 4790 - protein, 250 aa, Artificial Sequence; identical to SEQ ID NO: 293
  Description of Artificial Sequence: Synthetic single chain variable fragment

SEQ ID NO: 4791 - protein, 252 aa, Artificial Sequence; identical to SEQ ID NO: 294
  Description of Artificial Sequence: Synthetic single chain variable fragment

SEQ ID NO: 4792 - protein, 236 aa, Artificial Sequence; identical to SEQ ID NO: 295
  Description of Artificial Sequence: Synthetic single chain variable fragment

SEQ ID NO: 4793 - protein, 251 aa, Artificial Sequence; identical to SEQ ID NO: 296
  Description of Artificial Sequence: Synthetic single chain variable fragment

SEQ ID NO: 4794 - protein, 246 aa, Artificial Sequence; identical to SEQ ID NO: 297
  Description of Artificial Sequence: Synthetic single chain variable fragment

SEQ ID NO: 4795 - protein, 239 aa, Artificial Sequence; identical to SEQ ID NO: 298
  Description of Artificial Sequence: Synthetic single chain variable fragment

SEQ ID NO: 4796 - protein, 250 aa, Artificial Sequence; identical to SEQ ID NO: 299
  Description of Artificial Sequence: Synthetic single chain variable fragment

SEQ ID NO: 4797 - protein, 251 aa, Artificial Sequence; identical to SEQ ID NO: 300
  Description of Artificial Sequence: Synthetic single chain variable fragment

SEQ ID NO: 4798 - protein, 246 aa, Artificial Sequence; identical to SEQ ID NO: 303
  Description of Artificial Sequence: Synthetic single chain variable fragment

SEQ ID NO: 4799 - protein, 249 aa, Artificial Sequence; identical to SEQ ID NO: 304
  Description of Artificial Sequence: Synthetic single chain variable fragment

SEQ ID NO: 4800 - protein, 249 aa, Artificial Sequence; identical to SEQ ID NO: 305
  Description of Artificial Sequence: Synthetic single chain variable fragment

SEQ ID NO: 4801 - protein, 252 aa, Artificial Sequence; identical to SEQ ID NO: 288
  Description of Artificial Sequence: Synthetic single chain variable fragment

SEQ ID NO: 4802 - protein, 251 aa, Artificial Sequence; identical to SEQ ID NO: 309
  Description of Artificial Sequence: Synthetic single chain variable fragment

SEQ ID NO: 4803 - protein, 250 aa, Artificial Sequence; identical to SEQ ID NO: 310
  Description of Artificial Sequence: Synthetic single chain variable fragment

SEQ ID NO: 4804 - protein, 247 aa, Artificial Sequence; identical to SEQ ID NO: 311
  Description of Artificial Sequence: Synthetic single chain variable fragment

SEQ ID NO: 4805 - protein, 248 aa, Artificial Sequence; identical to SEQ ID NO: 312
  Description of Artificial Sequence: Synthetic single chain variable fragment

SEQ ID NO: 4806 - protein, 251 aa, Artificial Sequence; identical to SEQ ID NO: 314
  Description of Artificial Sequence: Synthetic single chain variable fragment

SEQ ID NO: 4807 - protein, 250 aa, Artificial Sequence; identical to SEQ ID NO: 316
  Description of Artificial Sequence: Synthetic single chain variable fragment

SEQ ID NO: 4808 - protein, 249 aa, Artificial Sequence; identical to SEQ ID NO: 320
  Description of Artificial Sequence: Synthetic single chain variable fragment

SEQ ID NO: 4809 - protein, 251 aa, Artificial Sequence; identical to SEQ ID NO: 321
  Description of Artificial Sequence: Synthetic single chain variable fragment

SEQ ID NO: 4810 - protein, 249 aa, Artificial Sequence; identical to SEQ ID NO: 284
  Description of Artificial Sequence: Synthetic single chain variable fragment

SEQ ID NO: 4811 - protein, 277 aa, Artificial Sequence; identical to SEQ ID NO: 417
  Description of Artificial Sequence: Synthetic single chain variable fragment

SEQ ID NO: 4812 - protein, 246 aa, Artificial Sequence; identical to SEQ ID NO: 765
  Description of Artificial Sequence: Synthetic scFV sequence

SEQ ID NO: 4813 - protein, 246 aa, Artificial Sequence; identical to SEQ ID NO: 766
  Description of Artificial Sequence: Synthetic scFV sequence

SEQ ID NO: 4814 - protein, 245 aa, Artificial Sequence; identical to SEQ ID NO: 767
  Description of Artificial Sequence: Synthetic scFV sequence

SEQ ID NO: 4815 - protein, 242 aa, Artificial Sequence; identical to SEQ ID NO: 768
  Description of Artificial Sequence: Synthetic scFV sequence

SEQ ID NO: 4816 - protein, 248 aa, Artificial Sequence; identical to SEQ ID NO: 769
  Description of Artificial Sequence: Synthetic scFV sequence

SEQ ID NO: 4817 - protein, 247 aa, Artificial Sequence; identical to SEQ ID NO: 770
  Description of Artificial Sequence: Synthetic scFV sequence

SEQ ID NO: 4818 - protein, 246 aa, Artificial Sequence; identical to SEQ ID NO: 771
  Description of Artificial Sequence: Synthetic scFV sequence

SEQ ID NO: 4819 - protein, 243 aa, Artificial Sequence; identical to SEQ ID NO: 772
  Description of Artificial Sequence: Synthetic scFV sequence

SEQ ID NO: 4820 - protein, 236 aa, Artificial Sequence; identical to SEQ ID NO: 778
  Description of Artificial Sequence: Synthetic scFV sequence

SEQ ID NO: 4821 - protein, 245 aa, Artificial Sequence; identical to SEQ ID NO: 779
  Description of Artificial Sequence: Synthetic scFV sequence

SEQ ID NO: 4822 - protein, 245 aa, Artificial Sequence; identical to SEQ ID NO: 780
  Description of Artificial Sequence: Synthetic scFV sequence

SEQ ID NO: 4823 - protein, 244 aa, Artificial Sequence; identical to SEQ ID NO: 789
  Description of Artificial Sequence: Synthetic scFV sequence

SEQ ID NO: 4824 - protein, 244 aa, Artificial Sequence; identical to SEQ ID NO: 790
  Description of Artificial Sequence: Synthetic scFV sequence

SEQ ID NO: 4825 - protein, 248 aa, Artificial Sequence; identical to SEQ ID NO: 791
  Description of Artificial Sequence: Synthetic scFV sequence

SEQ ID NO: 4826 - protein, 242 aa, Artificial Sequence; identical to SEQ ID NO: 792
  Description of Artificial Sequence: Synthetic scFV sequence

SEQ ID NO: 4827 - protein, 518 aa, Artificial Sequence; identical to SEQ ID NO: 872
  Description of Artificial Sequence: Synthetic scFV sequence

SEQ ID NO: 4828 - protein, 524 aa, Artificial Sequence; identical to SEQ ID NO: 873
  Description of Artificial Sequence: Synthetic scFV sequence

SEQ ID NO: 4829 - protein, 248 aa, Artificial Sequence; identical to SEQ ID NO: 874
  Description of Artificial Sequence: Synthetic scFV sequence

SEQ ID NO: 4830 - protein, 225 aa, Artificial Sequence; identical to SEQ ID NO: 875
  Description of Artificial Sequence: Synthetic scFV sequence

SEQ ID NO: 4831 - protein, 244 aa, Artificial Sequence; identical to SEQ ID NO: 876
  Description of Artificial Sequence: Synthetic scFV sequence

SEQ ID NO: 4832 - protein, 230 aa, Artificial Sequence; identical to SEQ ID NO: 877
  Description of Artificial Sequence: Synthetic scFV sequence

SEQ ID NO: 4833 - protein, 241 aa, Artificial Sequence; identical to SEQ ID NO: 878
  Description of Artificial Sequence: Synthetic scFV sequence

SEQ ID NO: 4834 - protein, 249 aa, Artificial Sequence; identical to SEQ ID NO: 879
  Description of Artificial Sequence: Synthetic scFV sequence

SEQ ID NO: 4835 - protein, 244 aa, Artificial Sequence; identical to SEQ ID NO: 880
  Description of Artificial Sequence: Synthetic scFV sequence

SEQ ID NO: 4836 - protein, 243 aa, Artificial Sequence; identical to SEQ ID NO: 881
  Description of Artificial Sequence: Synthetic scFV sequence

SEQ ID NO: 4837 - protein, 241 aa, Artificial Sequence; identical to SEQ ID NO: 882
  Description of Artificial Sequence: Synthetic scFV sequence

SEQ ID NO: 4838 - protein, 239 aa, Artificial Sequence; identical to SEQ ID NO: 883
  Description of Artificial Sequence: Synthetic scFV sequence

SEQ ID NO: 4839 - protein, 239 aa, Artificial Sequence; identical to SEQ ID NO: 884
  Description of Artificial Sequence: Synthetic scFV sequence

SEQ ID NO: 4840 - protein, 239 aa, Artificial Sequence; identical to SEQ ID NO: 885
  Description of Artificial Sequence: Synthetic scFV sequence

SEQ ID NO: 4841 - protein, 239 aa, Artificial Sequence; identical to SEQ ID NO: 886
  Description of Artificial Sequence: Synthetic scFV sequence

SEQ ID NO: 4842 - protein, 239 aa, Artificial Sequence; identical to SEQ ID NO: 887
  Description of Artificial Sequence: Synthetic scFV sequence

SEQ ID NO: 4843 - protein, 239 aa, Artificial Sequence; identical to SEQ ID NO: 888
  Description of Artificial Sequence: Synthetic scFV sequence

SEQ ID NO: 4844 - protein, 239 aa, Artificial Sequence; identical to SEQ ID NO: 889
  Description of Artificial Sequence: Synthetic scFV sequence

SEQ ID NO: 4845 - protein, 239 aa, Artificial Sequence; identical to SEQ ID NO: 890
  Description of Artificial Sequence: Synthetic scFV sequence

SEQ ID NO: 4846 - protein, 239 aa, Artificial Sequence; identical to SEQ ID NO: 891
  Description of Artificial Sequence: Synthetic scFV sequence

SEQ ID NO: 4847 - protein, 239 aa, Artificial Sequence; identical to SEQ ID NO: 892
  Description of Artificial Sequence: Synthetic scFV sequence

SEQ ID NO: 4848 - protein, 239 aa, Artificial Sequence; identical to SEQ ID NO: 893
  Description of Artificial Sequence: Synthetic scFV sequence

SEQ ID NO: 4849 - protein, 239 aa, Artificial Sequence; identical to SEQ ID NO: 894
  Description of Artificial Sequence: Synthetic scFV sequence

SEQ ID NO: 4850 - protein, 239 aa, Artificial Sequence; identical to SEQ ID NO: 895
  Description of Artificial Sequence: Synthetic scFV sequence

SEQ ID NO: 4851 - protein, 239 aa, Artificial Sequence; identical to SEQ ID NO: 896
  Description of Artificial Sequence: Synthetic scFV sequence

SEQ ID NO: 4852 - protein, 100 aa, Artificial Sequence; identical to SEQ ID NO: 897
  Description of Artificial Sequence: Synthetic scFV sequence

SEQ ID NO: 4853 - protein, 139 aa, Artificial Sequence; identical to SEQ ID NO: 898
  Description of Artificial Sequence: Synthetic scFV sequence

SEQ ID NO: 4854 - protein, 243 aa, Artificial Sequence; identical to SEQ ID NO: 899
  Description of Artificial Sequence: Synthetic scFV sequence

SEQ ID NO: 4855 - protein, 242 aa, Artificial Sequence; identical to SEQ ID NO: 900
  Description of Artificial Sequence: Synthetic scFV sequence

SEQ ID NO: 4856 - protein, 263 aa, Artificial Sequence; identical to SEQ ID NO: 973
  Description of Artificial Sequence: Synthetic scFV sequence

SEQ ID NO: 4857 - protein, 242 aa, Artificial Sequence; identical to SEQ ID NO: 974
  Description of Artificial Sequence: Synthetic scFV sequence

SEQ ID NO: 4858 - protein, 477 aa, Artificial Sequence; identical to SEQ ID NO: 975
  Description of Artificial Sequence: Synthetic scFV sequence

SEQ ID NO: 4859 - protein, 291 aa, Artificial Sequence; identical to SEQ ID NO: 976
  Description of Artificial Sequence: Synthetic scFV sequence

SEQ ID NO: 4860 - protein, 291 aa, Artificial Sequence; identical to SEQ ID NO: 977
  Description of Artificial Sequence: Synthetic scFV sequence

SEQ ID NO: 4861 - protein, 665 aa, Artificial Sequence; identical to SEQ ID NO: 978
  Description of Artificial Sequence: Synthetic scFV sequence

SEQ ID NO: 4862 - protein, 278 aa, Artificial Sequence; identical to SEQ ID NO: 979
  Description of Artificial Sequence: Synthetic scFV sequence

SEQ ID NO: 4863 - protein, 280 aa, Artificial Sequence; identical to SEQ ID NO: 980
  Description of Artificial Sequence: Synthetic scFV sequence

SEQ ID NO: 4864 - protein, 680 aa, Artificial Sequence; identical to SEQ ID NO: 1354
  Description of Artificial Sequence: Synthetic chimeric antigen receptor

SEQ ID NO: 4865 - protein, 680 aa, Artificial Sequence; identical to SEQ ID NO: 1355
  Description of Artificial Sequence: Synthetic chimeric antigen receptor

SEQ ID NO: 4866 - protein, 680 aa, Artificial Sequence; identical to SEQ ID NO: 1356
  Description of Artificial Sequence: Synthetic chimeric antigen receptor

SEQ ID NO: 4867 - protein, 580 aa, Artificial Sequence; identical to SEQ ID NO: 1357
  Description of Artificial Sequence: Synthetic chimeric antigen receptor

SEQ ID NO: 4868 - protein, 711 aa, Artificial Sequence; identical to SEQ ID NO: 1358
  Description of Artificial Sequence: Synthetic chimeric antigen receptor

SEQ ID NO: 4869 - protein, 495 aa, Artificial Sequence; identical to SEQ ID NO: 1359
  Description of Artificial Sequence: Synthetic chimeric antigen receptor

SEQ ID NO: 4870 - protein, 495 aa, Artificial Sequence; identical to SEQ ID NO: 307
  Description of Artificial Sequence: Synthetic chimeric antigen receptor

SEQ ID NO: 4871 - protein, 484 aa, Artificial Sequence; identical to SEQ ID NO: 1361
  Description of Artificial Sequence: Synthetic chimeric antigen receptor

SEQ ID NO: 4872 - protein, 476 aa, Artificial Sequence; identical to SEQ ID NO: 1362
  Description of Artificial Sequence: Synthetic chimeric antigen receptor

SEQ ID NO: 4873 - protein, 248 aa, Artificial Sequence; identical to SEQ ID NO: 1363
  Description of Artificial Sequence: Synthetic chimeric antigen receptor

SEQ ID NO: 4874 - protein, 254 aa, Artificial Sequence; identical to SEQ ID NO: 1364
  Description of Artificial Sequence: Synthetic chimeric antigen receptor

SEQ ID NO: 4875 - protein, 489 aa, Artificial Sequence; identical to SEQ ID NO: 1365
  Description of Artificial Sequence: Synthetic chimeric antigen receptor

SEQ ID NO: 4876 - protein, 522 aa, Artificial Sequence; identical to SEQ ID NO: 1366
  Description of Artificial Sequence: Synthetic chimeric antigen receptor

SEQ ID NO: 4877 - protein, 508 aa, Artificial Sequence; identical to SEQ ID NO: 1367
  Description of Artificial Sequence: Synthetic chimeric antigen receptor

SEQ ID NO: 4878 - protein, 528 aa, Artificial Sequence; identical to SEQ ID NO: 1368
  Description of Artificial Sequence: Synthetic chimeric antigen receptor

SEQ ID NO: 4879 - protein, 514 aa, Artificial Sequence; identical to SEQ ID NO: 1369
  Description of Artificial Sequence: Synthetic chimeric antigen receptor

SEQ ID NO: 4880 - protein, 522 aa, Artificial Sequence; identical to SEQ ID NO: 1370
  Description of Artificial Sequence: Synthetic chimeric antigen receptor

SEQ ID NO: 4881 - protein, 508 aa, Artificial Sequence; identical to SEQ ID NO: 1371
  Description of Artificial Sequence: Synthetic chimeric antigen receptor

SEQ ID NO: 4882 - protein, 495 aa, Artificial Sequence; identical to SEQ ID NO: 307
  Description of Artificial Sequence: Synthetic chimeric antigen receptor

SEQ ID NO: 4883 - protein, 495 aa, Artificial Sequence; identical to SEQ ID NO: 307
  Description of Artificial Sequence: Synthetic chimeric antigen receptor

SEQ ID NO: 4884 - protein, 495 aa, Artificial Sequence; identical to SEQ ID NO: 307
  Description of Artificial Sequence: Synthetic chimeric antigen receptor

SEQ ID NO: 4885 - protein, 495 aa, Artificial Sequence; identical to SEQ ID NO: 307
  Description of Artificial Sequence: Synthetic chimeric antigen receptor

SEQ ID NO: 4886 - protein, 495 aa, Artificial Sequence; identical to SEQ ID NO: 307
  Description of Artificial Sequence: Synthetic chimeric antigen receptor

SEQ ID NO: 4887 - protein, 495 aa, Artificial Sequence; identical to SEQ ID NO: 307
  Description of Artificial Sequence: Synthetic chimeric antigen receptor

SEQ ID NO: 4888 - protein, 495 aa, Artificial Sequence; identical to SEQ ID NO: 307
  Description of Artificial Sequence: Synthetic chimeric antigen receptor

SEQ ID NO: 4889 - protein, 495 aa, Artificial Sequence; identical to SEQ ID NO: 307
  Description of Artificial Sequence: Synthetic chimeric antigen receptor

SEQ ID NO: 4890 - protein, 251 aa, Artificial Sequence; identical to SEQ ID NO: 386
  Description of Artificial Sequence: Synthetic chimeric antigen receptor

SEQ ID NO: 4891 - protein, 495 aa, Artificial Sequence; identical to SEQ ID NO: 307
  Description of Artificial Sequence: Synthetic chimeric antigen receptor

SEQ ID NO: 4892 - protein, 495 aa, Artificial Sequence; identical to SEQ ID NO: 307
  Description of Artificial Sequence: Synthetic chimeric antigen receptor

SEQ ID NO: 4893 - protein, 495 aa, Artificial Sequence; identical to SEQ ID NO: 307
  Description of Artificial Sequence: Synthetic chimeric antigen receptor

SEQ ID NO: 4894 - protein, 495 aa, Artificial Sequence; identical to SEQ ID NO: 1359
  Description of Artificial Sequence: Synthetic chimeric antigen receptor

SEQ ID NO: 4895 - protein, 495 aa, Artificial Sequence; identical to SEQ ID NO: 307
  Description of Artificial Sequence: Synthetic chimeric antigen receptor

SEQ ID NO: 4896 - protein, 495 aa, Artificial Sequence; identical to SEQ ID NO: 1359
  Description of Artificial Sequence: Synthetic chimeric antigen receptor

SEQ ID NO: 4897 - protein, 495 aa, Artificial Sequence; identical to SEQ ID NO: 307
  Description of Artificial Sequence: Synthetic chimeric antigen receptor

SEQ ID NO: 4898 - protein, 495 aa, Artificial Sequence; identical to SEQ ID NO: 1359
  Description of Artificial Sequence: Synthetic chimeric antigen receptor

SEQ ID NO: 4899 - protein, 495 aa, Artificial Sequence; identical to SEQ ID NO: 307
  Description of Artificial Sequence: Synthetic chimeric antigen receptor

SEQ ID NO: 4900 - protein, 494 aa, Artificial Sequence; identical to SEQ ID NO: 1390
  Description of Artificial Sequence: Synthetic chimeric antigen receptor

SEQ ID NO: 4901 - protein, 494 aa, Artificial Sequence; identical to SEQ ID NO: 1390
  Description of Artificial Sequence: Synthetic chimeric antigen receptor

SEQ ID NO: 4902 - protein, 144 aa, Artificial Sequence; identical to SEQ ID NO: 1392
  Description of Artificial Sequence: Synthetic chimeric antigen receptor

SEQ ID NO: 4903 - protein, 486 aa, Artificial Sequence; identical to SEQ ID NO: 1393
  Description of Artificial Sequence: Synthetic chimeric antigen receptor

SEQ ID NO: 4904 - protein, 486 aa, Artificial Sequence; identical to SEQ ID NO: 1394
  Description of Artificial Sequence: Synthetic chimeric antigen receptor

SEQ ID NO: 4905 - protein, 486 aa, Artificial Sequence; identical to SEQ ID NO: 1395
  Description of Artificial Sequence: Synthetic chimeric antigen receptor

SEQ ID NO: 4906 - protein, 486 aa, Artificial Sequence; identical to SEQ ID NO: 1396
  Description of Artificial Sequence: Synthetic chimeric antigen receptor

SEQ ID NO: 4907 - protein, 491 aa, Artificial Sequence; identical to SEQ ID NO: 1397
  Description of Artificial Sequence: Synthetic chimeric antigen receptor

SEQ ID NO: 4908 - protein, 491 aa, Artificial Sequence; identical to SEQ ID NO: 1398
  Description of Artificial Sequence: Synthetic chimeric antigen receptor

SEQ ID NO: 4909 - protein, 491 aa, Artificial Sequence; identical to SEQ ID NO: 1399
  Description of Artificial Sequence: Synthetic chimeric antigen receptor

SEQ ID NO: 4910 - protein, 491 aa, Artificial Sequence; identical to SEQ ID NO: 1400
  Description of Artificial Sequence: Synthetic chimeric antigen receptor

SEQ ID NO: 4911 - protein, 491 aa, Artificial Sequence; identical to SEQ ID NO: 1401
  Description of Artificial Sequence: Synthetic chimeric antigen receptor

SEQ ID NO: 4912 - protein, 491 aa, Artificial Sequence; identical to SEQ ID NO: 1401
  Description of Artificial Sequence: Synthetic chimeric antigen receptor

SEQ ID NO: 4913 - protein, 491 aa, Artificial Sequence; identical to SEQ ID NO: 1403
  Description of Artificial Sequence: Synthetic chimeric antigen receptor

SEQ ID NO: 4914 - protein, 486 aa, Artificial Sequence; identical to SEQ ID NO: 1404
  Description of Artificial Sequence: Synthetic chimeric antigen receptor

SEQ ID NO: 4915 - protein, 486 aa, Artificial Sequence; identical to SEQ ID NO: 669
  Description of Artificial Sequence: Synthetic chimeric antigen receptor

SEQ ID NO: 4916 - protein, 495 aa, Artificial Sequence; identical to SEQ ID NO: 1359
  Description of Artificial Sequence: Synthetic chimeric antigen receptor

SEQ ID NO: 4917 - protein, 495 aa, Artificial Sequence; identical to SEQ ID NO: 307
  Description of Artificial Sequence: Synthetic chimeric antigen receptor

SEQ ID NO: 4918 - protein, 530 aa, Artificial Sequence; identical to SEQ ID NO: 1408
  Description of Artificial Sequence: Synthetic chimeric antigen receptor

SEQ ID NO: 4919 - protein, 486 aa, Artificial Sequence; identical to SEQ ID NO: 1394
  Description of Artificial Sequence: Synthetic chimeric antigen receptor

SEQ ID NO: 4920 - protein, 486 aa, Artificial Sequence; identical to SEQ ID NO: 1395
  Description of Artificial Sequence: Synthetic chimeric antigen receptor

SEQ ID NO: 4921 - protein, 486 aa, Artificial Sequence; identical to SEQ ID NO: 1396
  Description of Artificial Sequence: Synthetic chimeric antigen receptor

SEQ ID NO: 4922 - protein, 491 aa, Artificial Sequence; identical to SEQ ID NO: 1397
  Description of Artificial Sequence: Synthetic chimeric antigen receptor

SEQ ID NO: 4923 - protein, 491 aa, Artificial Sequence; identical to SEQ ID NO: 1398
  Description of Artificial Sequence: Synthetic chimeric antigen receptor

SEQ ID NO: 4924 - protein, 491 aa, Artificial Sequence; identical to SEQ ID NO: 1399
  Description of Artificial Sequence: Synthetic chimeric antigen receptor

SEQ ID NO: 4925 - protein, 491 aa, Artificial Sequence; identical to SEQ ID NO: 1400
  Description of Artificial Sequence: Synthetic chimeric antigen receptor

SEQ ID NO: 4926 - protein, 491 aa, Artificial Sequence; identical to SEQ ID NO: 1401
  Description of Artificial Sequence: Synthetic chimeric antigen receptor

SEQ ID NO: 4927 - protein, 491 aa, Artificial Sequence; identical to SEQ ID NO: 1401
  Description of Artificial Sequence: Synthetic chimeric antigen receptor

SEQ ID NO: 4928 - protein, 491 aa, Artificial Sequence; identical to SEQ ID NO: 1403
  Description of Artificial Sequence: Synthetic chimeric antigen receptor

SEQ ID NO: 4929 - protein, 486 aa, Artificial Sequence; identical to SEQ ID NO: 1404
  Description of Artificial Sequence: Synthetic chimeric antigen receptor

SEQ ID NO: 4930 - protein, 465 aa, Artificial Sequence; identical to SEQ ID NO: 1420
  Description of Artificial Sequence: Synthetic chimeric antigen receptor

SEQ ID NO: 4931 - protein, 681 aa, Artificial Sequence; identical to SEQ ID NO: 1421
  Description of Artificial Sequence: Synthetic chimeric antigen receptor

SEQ ID NO: 4932 - protein, 838 aa, Artificial Sequence; identical to SEQ ID NO: 1422
  Description of Artificial Sequence: Synthetic chimeric antigen receptor

SEQ ID NO: 4933 - protein, 1055 aa, Artificial Sequence [sequence omitted]

SEQ ID NO: 4934 - protein, 945 aa, Artificial Sequence; identical to SEQ ID NO: 1424
  Description of Artificial Sequence: Synthetic chimeric antigen receptor

SEQ ID NO: 4935 - protein, 845 aa, Artificial Sequence; identical to SEQ ID NO: 1425
  Description of Artificial Sequence: Synthetic chimeric antigen receptor

SEQ ID NO: 4936 - protein, 952 aa, Artificial Sequence; identical to SEQ ID NO: 1426
  Description of Artificial Sequence: Synthetic chimeric antigen receptor

SEQ ID NO: 4937 - protein, 1062 aa, Artificial Sequence; identical to SEQ ID NO: 1427
  Description of Artificial Sequence: Synthetic chimeric antigen receptor

SEQ ID NO: 4938 - protein, 502 aa, Artificial Sequence; identical to SEQ ID NO: 1428
  Description of Artificial Sequence: Synthetic chimeric antigen receptor

SEQ ID NO: 4939 - protein, 508 aa, Artificial Sequence; identical to SEQ ID NO: 1429
  Description of Artificial Sequence: Synthetic chimeric antigen receptor

SEQ ID NO: 4940 - protein, 509 aa, Artificial Sequence; identical to SEQ ID NO: 1430
  Description of Artificial Sequence: Synthetic chimeric antigen receptor

SEQ ID NO: 4941 - protein, 550 aa, Artificial Sequence; identical to SEQ ID NO: 1431
  Description of Artificial Sequence: Synthetic chimeric antigen receptor

SEQ ID NO: 4942 - protein, 556 aa, Artificial Sequence; identical to SEQ ID NO: 1432
  Description of Artificial Sequence: Synthetic chimeric antigen receptor

SEQ ID NO: 4943 - protein, 506 aa, Artificial Sequence; identical to SEQ ID NO: 1433
  Description of Artificial Sequence: Synthetic chimeric antigen receptor

SEQ ID NO: 4944 - protein, 560 aa, Artificial Sequence; identical to SEQ ID NO: 1434
  Description of Artificial Sequence: Synthetic chimeric antigen receptor

SEQ ID NO: 4945 - protein, 513 aa, Artificial Sequence; identical to SEQ ID NO: 1435
  Description of Artificial Sequence: Synthetic chimeric antigen receptor

SEQ ID NO: 4946 - protein, 554 aa, Artificial Sequence; identical to SEQ ID NO: 1436
  Description of Artificial Sequence: Synthetic chimeric antigen receptor

SEQ ID NO: 4947 - protein, 476 aa, Artificial Sequence; identical to SEQ ID NO: 1437
  Description of Artificial Sequence: Synthetic chimeric antigen receptor

SEQ ID NO: 4948 - protein, 480 aa, Artificial Sequence; identical to SEQ ID NO: 1438
  Description of Artificial Sequence: Synthetic chimeric antigen receptor

SEQ ID NO: 4949 - protein, 428 aa, Artificial Sequence; identical to SEQ ID NO: 1439
  Description of Artificial Sequence: Synthetic chimeric antigen receptor

SEQ ID NO: 4950 - protein, 432 aa, Artificial Sequence; identical to SEQ ID NO: 1440
  Description of Artificial Sequence: Synthetic chimeric antigen receptor

SEQ ID NO: 4951 - protein, 486 aa, Artificial Sequence; identical to SEQ ID NO: 1393
  Description of Artificial Sequence: Synthetic chimeric antigen receptor

SEQ ID NO: 4952 - protein, 486 aa, Artificial Sequence; identical to SEQ ID NO: 1394
  Description of Artificial Sequence: Synthetic chimeric antigen receptor

SEQ ID NO: 4953 - protein, 486 aa, Artificial Sequence; identical to SEQ ID NO: 1395
  Description of Artificial Sequence: Synthetic chimeric antigen receptor

SEQ ID NO: 4954 - protein, 486 aa, Artificial Sequence; identical to SEQ ID NO: 1396
  Description of Artificial Sequence: Synthetic chimeric antigen receptor

SEQ ID NO: 4955 - protein, 491 aa, Artificial Sequence; identical to SEQ ID NO: 1397
  Description of Artificial Sequence: Synthetic chimeric antigen receptor

SEQ ID NO: 4956 - protein, 491 aa, Artificial Sequence; identical to SEQ ID NO: 1398
  Description of Artificial Sequence: Synthetic chimeric antigen receptor

SEQ ID NO: 4957 - protein, 491 aa, Artificial Sequence; identical to SEQ ID NO: 1399
  Description of Artificial Sequence: Synthetic chimeric antigen receptor

SEQ ID NO: 4958 - protein, 491 aa, Artificial Sequence; identical to SEQ ID NO: 1400
  Description of Artificial Sequence: Synthetic chimeric antigen receptor

SEQ ID NO: 4959 - protein, 491 aa, Artificial Sequence; identical to SEQ ID NO: 1401
  Description of Artificial Sequence: Synthetic chimeric antigen receptor

SEQ ID NO: 4960 - protein, 491 aa, Artificial Sequence; identical to SEQ ID NO: 1401
  Description of Artificial Sequence: Synthetic chimeric antigen receptor

SEQ ID NO: 4961 - protein, 491 aa, Artificial Sequence; identical to SEQ ID NO: 1403
  Description of Artificial Sequence: Synthetic chimeric antigen receptor

SEQ ID NO: 4962 - protein, 486 aa, Artificial Sequence; identical to SEQ ID NO: 1404
  Description of Artificial Sequence: Synthetic chimeric antigen receptor

SEQ ID NO: 4963 - protein, 486 aa, Artificial Sequence; identical to SEQ ID NO: 669
  Description of Artificial Sequence: Synthetic chimeric antigen receptor

SEQ ID NO: 4964 - protein, 486 aa, Artificial Sequence; identical to SEQ ID NO: 1393
  Description of Artificial Sequence: Synthetic chimeric antigen receptor

SEQ ID NO: 4965 - protein, 486 aa, Artificial Sequence; identical to SEQ ID NO: 1394
  Description of Artificial Sequence: Synthetic chimeric antigen receptor

SEQ ID NO: 4966 - protein, 486 aa, Artificial Sequence; identical to SEQ ID NO: 1395
  Description of Artificial Sequence: Synthetic chimeric antigen receptor

SEQ ID NO: 4967 - protein, 486 aa, Artificial Sequence; identical to SEQ ID NO: 1396
  Description of Artificial Sequence: Synthetic chimeric antigen receptor

SEQ ID NO: 4968 - protein, 491 aa, Artificial Sequence; identical to SEQ ID NO: 1397
  Description of Artificial Sequence: Synthetic chimeric antigen receptor

SEQ ID NO: 4969 - protein, 491 aa, Artificial Sequence; identical to SEQ ID NO: 1398
  Description of Artificial Sequence: Synthetic chimeric antigen receptor

SEQ ID NO: 4970 - protein, 491 aa, Artificial Sequence; identical to SEQ ID NO: 1399
  Description of Artificial Sequence: Synthetic chimeric antigen receptor

SEQ ID NO: 4971 - protein, 491 aa, Artificial Sequence; identical to SEQ ID NO: 1400
  Description of Artificial Sequence: Synthetic chimeric antigen receptor

SEQ ID NO: 4972 - protein, 491 aa, Artificial Sequence; identical to SEQ ID NO: 1401
  Description of Artificial Sequence: Synthetic chimeric antigen receptor

SEQ ID NO: 4973 - protein, 491 aa, Artificial Sequence; identical to SEQ ID NO: 1401
  Description of Artificial Sequence: Synthetic chimeric antigen receptor

SEQ ID NO: 4974 - protein, 491 aa, Artificial Sequence; identical to SEQ ID NO: 1403
  Description of Artificial Sequence: Synthetic chimeric antigen receptor

SEQ ID NO: 4975 - protein, 486 aa, Artificial Sequence; identical to SEQ ID NO: 1404
  Description of Artificial Sequence: Synthetic chimeric antigen receptor

SEQ ID NO: 4976 - protein, 527 aa, Artificial Sequence; identical to SEQ ID NO: 1466
  Description of Artificial Sequence: Synthetic chimeric antigen receptor

SEQ ID NO: 4977 - protein, 527 aa, Artificial Sequence; identical to SEQ ID NO: 1467
  Description of Artificial Sequence: Synthetic chimeric antigen receptor

SEQ ID NO: 4978 - protein, 222 aa, Artificial Sequence; identical to SEQ ID NO: 454
  Description of Artificial Sequence: Synthetic chimeric antigen receptor

SEQ ID NO: 4979 - protein, 226 aa, Artificial Sequence; identical to SEQ ID NO: 559
  Description of Artificial Sequence: Synthetic chimeric antigen receptor

SEQ ID NO: 4980 - protein, 286 aa, Artificial Sequence; identical to SEQ ID NO: 558
  Description of Artificial Sequence: Synthetic chimeric antigen receptor

SEQ ID NO: 4981 - protein, 726 aa, Artificial Sequence; identical to SEQ ID NO: 1471
  Description of Artificial Sequence: Synthetic chimeric antigen receptor

SEQ ID NO: 4982 - protein, 490 aa, Artificial Sequence; identical to SEQ ID NO: 1472
  Description of Artificial Sequence: Synthetic chimeric antigen receptor

SEQ ID NO: 4983 - protein, 730 aa, Artificial Sequence; identical to SEQ ID NO: 1473
  Description of Artificial Sequence: Synthetic chimeric antigen receptor

SEQ ID NO: 4984 - protein, 494 aa, Artificial Sequence; identical to SEQ ID NO: 1474
  Description of Artificial Sequence: Synthetic chimeric antigen receptor

SEQ ID NO: 4985 - protein, 790 aa, Artificial Sequence; identical to SEQ ID NO: 1475
  Description of Artificial Sequence: Synthetic chimeric antigen receptor

SEQ ID NO: 4986 - protein, 554 aa, Artificial Sequence; identical to SEQ ID NO: 1476
  Description of Artificial Sequence: Synthetic chimeric antigen receptor

SEQ ID NO: 4987 - protein, 728 aa, Artificial Sequence; identical to SEQ ID NO: 1477
  Description of Artificial Sequence: Synthetic chimeric antigen receptor

SEQ ID NO: 4988 - protein, 491 aa, Artificial Sequence; identical to SEQ ID NO: 1478
  Description of Artificial Sequence: Synthetic chimeric antigen receptor

SEQ ID NO: 4989 - protein, 732 aa, Artificial Sequence; identical to SEQ ID NO: 1479
  Description of Artificial Sequence: Synthetic chimeric antigen receptor

SEQ ID NO: 4990 - protein, 495 aa, Artificial Sequence; identical to SEQ ID NO: 1480
  Description of Artificial Sequence: Synthetic chimeric antigen receptor

SEQ ID NO: 4991 - protein, 792 aa, Artificial Sequence; identical to SEQ ID NO: 1481
  Description of Artificial Sequence: Synthetic chimeric antigen receptor

SEQ ID NO: 4992 - protein, 555 aa, Artificial Sequence; identical to SEQ ID NO: 1482
  Description of Artificial Sequence: Synthetic chimeric antigen receptor

SEQ ID NO: 4993 - protein, 725 aa, Artificial Sequence; identical to SEQ ID NO: 1483
  Description of Artificial Sequence: Synthetic chimeric antigen receptor

SEQ ID NO: 4994 - protein, 489 aa, Artificial Sequence; identical to SEQ ID NO: 1484
  Description of Artificial Sequence: Synthetic chimeric antigen receptor

SEQ ID NO: 4995 - protein, 729 aa, Artificial Sequence; identical to SEQ ID NO: 1485
  Description of Artificial Sequence: Synthetic chimeric antigen receptor

SEQ ID NO: 4996 - protein, 493 aa, Artificial Sequence; identical to SEQ ID NO: 1486
  Description of Artificial Sequence: Synthetic chimeric antigen receptor

SEQ ID NO: 4997 - protein, 789 aa, Artificial Sequence [sequence omitted]

SEQ ID NO: 4998 - protein, 553 aa, Artificial Sequence; identical to SEQ ID NO: 1488
  Description of Artificial Sequence: Synthetic chimeric antigen receptor

SEQ ID NO: 4999 - protein, 724 aa, Artificial Sequence; identical to SEQ ID NO: 1489
  Description of Artificial Sequence: Synthetic chimeric antigen receptor

SEQ ID NO: 5000 - protein, 487 aa, Artificial Sequence; identical to SEQ ID NO: 1490
  Description of Artificial Sequence: Synthetic chimeric antigen receptor

SEQ ID NO: 5001 - protein, 728 aa, Artificial Sequence; identical to SEQ ID NO: 1491
  Description of Artificial Sequence: Synthetic chimeric antigen receptor

SEQ ID NO: 5002 - protein, 491 aa, Artificial Sequence; identical to SEQ ID NO: 1492
  Description of Artificial Sequence: Synthetic chimeric antigen receptor

SEQ ID NO: 5003 - protein, 788 aa, Artificial Sequence; identical to SEQ ID NO: 1493
  Description of Artificial Sequence: Synthetic chimeric antigen receptor

SEQ ID NO: 5004 - protein, 551 aa, Artificial Sequence; identical to SEQ ID NO: 1494
  Description of Artificial Sequence: Synthetic chimeric antigen receptor

SEQ ID NO: 5005 - protein, 728 aa, Artificial Sequence; identical to SEQ ID NO: 1495
  Description of Artificial Sequence: Synthetic chimeric antigen receptor

SEQ ID NO: 5006 - protein, 492 aa, Artificial Sequence; identical to SEQ ID NO: 1496
  Description of Artificial Sequence: Synthetic chimeric antigen receptor

SEQ ID NO: 5007 - protein, 732 aa, Artificial Sequence [sequence omitted]

SEQ ID NO: 5008 - protein, 496 aa, Artificial Sequence; identical to SEQ ID NO: 1498
  Description of Artificial Sequence: Synthetic chimeric antigen receptor

SEQ ID NO: 5009 - protein, 792 aa, Artificial Sequence; identical to SEQ ID NO: 1499
  Description of Artificial Sequence: Synthetic chimeric antigen receptor

SEQ ID NO: 5010 - protein, 556 aa, Artificial Sequence; identical to SEQ ID NO: 1500
  Description of Artificial Sequence: Synthetic chimeric antigen receptor

SEQ ID NO: 5011 - protein, 728 aa, Artificial Sequence; identical to SEQ ID NO: 1501
  Description of Artificial Sequence: Synthetic chimeric antigen receptor

SEQ ID NO: 5012 - protein, 491 aa, Artificial Sequence; identical to SEQ ID NO: 1502
  Description of Artificial Sequence: Synthetic chimeric antigen receptor

SEQ ID NO: 5013 - protein, 732 aa, Artificial Sequence; identical to SEQ ID NO: 1503
  Description of Artificial Sequence: Synthetic chimeric antigen receptor

SEQ ID NO: 5014 - protein, 495 aa, Artificial Sequence; identical to SEQ ID NO: 1504
  Description of Artificial Sequence: Synthetic chimeric antigen receptor

SEQ ID NO: 5015 - protein, 792 aa, Artificial Sequence; identical to SEQ ID NO: 1505
  Description of Artificial Sequence: Synthetic chimeric antigen receptor

SEQ ID NO: 5016 - protein, 555 aa, Artificial Sequence; identical to SEQ ID NO: 1506
  Description of Artificial Sequence: Synthetic chimeric antigen receptor

SEQ ID NO: 5017 - protein, 726 aa, Artificial Sequence; identical to SEQ ID NO: 1507
  Description of Artificial Sequence: Synthetic chimeric antigen receptor

SEQ ID NO: 5018 - protein, 490 aa, Artificial Sequence; identical to SEQ ID NO: 1508
  Description of Artificial Sequence: Synthetic chimeric antigen receptor

SEQ ID NO: 5019 - protein, 730 aa, Artificial Sequence; identical to SEQ ID NO: 1509
  Description of Artificial Sequence: Synthetic chimeric antigen receptor

SEQ ID NO: 5020 - protein, 494 aa, Artificial Sequence; identical to SEQ ID NO: 1510
  Description of Artificial Sequence: Synthetic chimeric antigen receptor

SEQ ID NO: 5021 - protein, 790 aa, Artificial Sequence; identical to SEQ ID NO: 1511
  Description of Artificial Sequence: Synthetic chimeric antigen receptor

SEQ ID NO: 5022 - protein, 554 aa, Artificial Sequence; identical to SEQ ID NO: 1512
  Description of Artificial Sequence: Synthetic chimeric antigen receptor

SEQ ID NO: 5023 - protein, 724 aa, Artificial Sequence; identical to SEQ ID NO: 1513
  Description of Artificial Sequence: Synthetic chimeric antigen receptor

SEQ ID NO: 5024 - protein, 487 aa, Artificial Sequence; identical to SEQ ID NO: 1514
  Description of Artificial Sequence: Synthetic chimeric antigen receptor

SEQ ID NO: 5025 - protein, 728 aa, Artificial Sequence; identical to SEQ ID NO: 1515
  Description of Artificial Sequence: Synthetic chimeric antigen receptor

SEQ ID NO: 5026 - protein, 491 aa, Artificial Sequence; identical to SEQ ID NO: 1516
  Description of Artificial Sequence: Synthetic chimeric antigen receptor

SEQ ID NO: 5027 - protein, 788 aa, Artificial Sequence [sequence omitted]

SEQ ID NO: 5028 - protein, 551 aa, Artificial Sequence; identical to SEQ ID NO: 1518
  Description of Artificial Sequence: Synthetic chimeric antigen receptor

SEQ ID NO: 5029 - protein, 484 aa, Artificial Sequence; identical to SEQ ID NO: 1519
  Description of Artificial Sequence: Synthetic chimeric antigen receptor

SEQ ID NO: 5030 - protein, 480 aa, Artificial Sequence; identical to SEQ ID NO: 1520
  Description of Artificial Sequence: Synthetic chimeric antigen receptor

SEQ ID NO: 5031 - protein, 544 aa, Artificial Sequence; identical to SEQ ID NO: 1521
  Description of Artificial Sequence: Synthetic chimeric antigen receptor

SEQ ID NO: 5032 - protein, 727 aa, Artificial Sequence; identical to SEQ ID NO: 1522
  Description of Artificial Sequence: Synthetic chimeric antigen receptor

SEQ ID NO: 5033 - protein, 792 aa, Artificial Sequence; identical to SEQ ID NO: 1523
  Description of Artificial Sequence: Synthetic chimeric antigen receptor

SEQ ID NO: 5034 - protein, 506 aa, Artificial Sequence; identical to SEQ ID NO: 1524
  Description of Artificial Sequence: Synthetic chimeric antigen receptor

SEQ ID NO: 5035 - protein, 571 aa, Artificial Sequence; identical to SEQ ID NO: 1525
  Description of Artificial Sequence: Synthetic chimeric antigen receptor

SEQ ID NO: 5036 - protein, 727 aa, Artificial Sequence; identical to SEQ ID NO: 1526
  Description of Artificial Sequence: Synthetic chimeric antigen receptor

SEQ ID NO: 5037 - protein, 792 aa, Artificial Sequence [sequence omitted]

SEQ ID NO: 5038 - protein, 511 aa, Artificial Sequence; identical to SEQ ID NO: 1528
  Description of Artificial Sequence: Synthetic chimeric antigen receptor

SEQ ID NO: 5039 - protein, 703 aa, Artificial Sequence; identical to SEQ ID NO: 1529
  Description of Artificial Sequence: Synthetic chimeric antigen receptor

SEQ ID NO: 5040 - protein, 714 aa, Artificial Sequence; identical to SEQ ID NO: 1530
  Description of Artificial Sequence: Synthetic chimeric antigen receptor

SEQ ID NO: 5041 - protein, 701 aa, Artificial Sequence; identical to SEQ ID NO: 1531
  Description of Artificial Sequence: Synthetic chimeric antigen receptor

SEQ ID NO: 5042 - protein, 466 aa, Artificial Sequence; identical to SEQ ID NO: 1532
  Description of Artificial Sequence: Synthetic chimeric antigen receptor

SEQ ID NO: 5043 - protein, 470 aa, Artificial Sequence; identical to SEQ ID NO: 1533
  Description of Artificial Sequence: Synthetic chimeric antigen receptor

SEQ ID NO: 5044 - protein, 530 aa, Artificial Sequence; identical to SEQ ID NO: 1534
  Description of Artificial Sequence: Synthetic chimeric antigen receptor

SEQ ID NO: 5045 - protein, 470 aa, Artificial Sequence; identical to SEQ ID NO: 1535
  Description of Artificial Sequence: Synthetic chimeric antigen receptor

SEQ ID NO: 5046 - protein, 474 aa, Artificial Sequence; identical to SEQ ID NO: 1536
  Description of Artificial Sequence: Synthetic chimeric antigen receptor

SEQ ID NO: 5047 - protein, 534 aa, Artificial Sequence; identical to SEQ ID NO: 1537
  Description of Artificial Sequence: Synthetic chimeric antigen receptor

SEQ ID NO: 5048 - protein, 464 aa, Artificial Sequence; identical to SEQ ID NO: 1538
  Description of Artificial Sequence: Synthetic chimeric antigen receptor

SEQ ID NO: 5049 - protein, 468 aa, Artificial Sequence; identical to SEQ ID NO: 1539
  Description of Artificial Sequence: Synthetic chimeric antigen receptor

SEQ ID NO: 5050 - protein, 528 aa, Artificial Sequence; identical to SEQ ID NO: 1540
  Description of Artificial Sequence: Synthetic chimeric antigen receptor

SEQ ID NO: 5051 - protein, 223 aa, Artificial Sequence; identical to SEQ ID NO: 1541
  Description of Artificial Sequence: Synthetic chimeric antigen receptor

SEQ ID NO: 5052 - protein, 496 aa, Artificial Sequence; identical to SEQ ID NO: 1542
  Description of Artificial Sequence: Synthetic chimeric antigen receptor

SEQ ID NO: 5053 - DNA, 726 bp, Artificial Sequence; identical to SEQ ID NO: 420
  Description of Artificial Sequence: Synthetic CD19 scFv sequence

SEQ ID NO: 5054 - DNA, 726 bp, Artificial Sequence; identical to SEQ ID NO: 1295
  Description of Artificial Sequence: Synthetic CD19 scFv sequence

SEQ ID NO: 5055 - DNA, 726 bp, Artificial Sequence; identical to SEQ ID NO: 1296
  Description of Artificial Sequence: Synthetic CD19 scFv sequence

SEQ ID NO: 5056 - DNA, 726 bp, Artificial Sequence; identical to SEQ ID NO: 1297
  Description of Artificial Sequence: Synthetic CD19 scFv sequence

SEQ ID NO: 5057 - DNA, 726 bp, Artificial Sequence; identical to SEQ ID NO: 1298
  Description of Artificial Sequence: Synthetic CD19 scFv sequence

SEQ ID NO: 5058 - DNA, 726 bp, Artificial Sequence; identical to SEQ ID NO: 1299
  Description of Artificial Sequence: Synthetic CD19 scFv sequence

SEQ ID NO: 5059 - DNA, 207 bp, Artificial Sequence; identical to SEQ ID NO: 1549
  Description of Artificial Sequence: Synthetic Construct

SEQ ID NO: 5060 - DNA, 207 bp, Homo sapiens; identical to SEQ ID NO: 1301

SEQ ID NO: 5061 - DNA, 207 bp, Artificial Sequence; identical to SEQ ID NO: 1551
  Description of Artificial Sequence: Synthetic Construct

SEQ ID NO: 5062 - DNA, 207 bp, Artificial Sequence; identical to SEQ ID NO: 1552
  Description of Artificial Sequence: Synthetic Construct

SEQ ID NO: 5063 - DNA, 207 bp, Artificial Sequence; identical to SEQ ID NO: 1553
  Description of Artificial Sequence: Synthetic Construct

SEQ ID NO: 5064 - DNA, 135 bp, Artificial Sequence; identical to SEQ ID NO: 1303
  Description of Artificial Sequence: Synthetic Construct

SEQ ID NO: 5065 - DNA, 135 bp, Artificial Sequence; identical to SEQ ID NO: 1304
  Description of Artificial Sequence: Synthetic Construct

SEQ ID NO: 5066 - DNA, 135 bp, Artificial Sequence; identical to SEQ ID NO: 1305
  Description of Artificial Sequence: Synthetic Construct

SEQ ID NO: 5067 - DNA, 135 bp, Artificial Sequence; identical to SEQ ID NO: 1306
  Description of Artificial Sequence: Synthetic Construct

SEQ ID NO: 5068 - DNA, 135 bp, Artificial Sequence; identical to SEQ ID NO: 1307
  Description of Artificial Sequence: Synthetic Construct

SEQ ID NO: 5069 - DNA, 336 bp, Artificial Sequence; identical to SEQ ID NO: 1559
  Description of Artificial Sequence: Synthetic Construct

SEQ ID NO: 5070 - DNA, 336 bp, Artificial Sequence; identical to SEQ ID NO: 1560
  Description of Artificial Sequence: Synthetic Construct

SEQ ID NO: 5071 - DNA, 336 bp, Artificial Sequence; identical to SEQ ID NO: 1561
  Description of Artificial Sequence: Synthetic Construct

SEQ ID NO: 5072 - DNA, 336 bp, Artificial Sequence; identical to SEQ ID NO: 1562
  Description of Artificial Sequence: Synthetic Construct

SEQ ID NO: 5073 - DNA, 336 bp, Artificial Sequence; identical to SEQ ID NO: 1563
  Description of Artificial Sequence: Synthetic Construct

SEQ ID NO: 5074 - DNA, 336 bp, Artificial Sequence; identical to SEQ ID NO: 1564
  Description of Artificial Sequence: Synthetic Construct

SEQ ID NO: 5075 - DNA, 126 bp, Artificial Sequence; identical to SEQ ID NO: 1315
  Description of Artificial Sequence: Synthetic Construct

SEQ ID NO: 5076 - DNA, 126 bp, Artificial Sequence; identical to SEQ ID NO: 1316
  Description of Artificial Sequence: Synthetic Construct

SEQ ID NO: 5077 - DNA, 126 bp, Artificial Sequence; identical to SEQ ID NO: 1317
  Description of Artificial Sequence: Synthetic Construct

SEQ ID NO: 5078 - DNA, 126 bp, Artificial Sequence; identical to SEQ ID NO: 1318
  Description of Artificial Sequence: Synthetic Construct

SEQ ID NO: 5079 - DNA, 126 bp, Artificial Sequence; identical to SEQ ID NO: 1319
  Description of Artificial Sequence: Synthetic Construct

SEQ ID NO: 5080 - DNA, 126 bp, Artificial Sequence; identical to SEQ ID NO: 1570
  Description of Artificial Sequence: Synthetic Construct

SEQ ID NO: 5081 - DNA, 72 bp, Artificial Sequence; identical to SEQ ID NO: 1571
  Description of Artificial Sequence: Synthetic Construct

SEQ ID NO: 5082 - DNA, 72 bp, Artificial Sequence; identical to SEQ ID NO: 1572
  Description of Artificial Sequence: Synthetic Construct

SEQ ID NO: 5083 - DNA, 63 bp, Homo sapiens; identical to SEQ ID NO: 1321

SEQ ID NO: 5084 - DNA, 63 bp, Artificial Sequence; identical to SEQ ID NO: 1322
  Description of Artificial Sequence: Synthetic signal sequence

SEQ ID NO: 5085 - DNA, 63 bp, Artificial Sequence; identical to SEQ ID NO: 1323
  Description of Artificial Sequence: Synthetic signal sequence

SEQ ID NO: 5086 - DNA, 63 bp, Artificial Sequence; identical to SEQ ID NO: 1324
  Description of Artificial Sequence: Synthetic signal sequence

SEQ ID NO: 5087 - DNA, 63 bp, Artificial Sequence; identical to SEQ ID NO: 1325
  Description of Artificial Sequence: Synthetic signal sequence

SEQ ID NO: 5088 - DNA, 66 bp, Homo sapiens; identical to SEQ ID NO: 1580

SEQ ID NO: 5089 - DNA, 66 bp, Artificial Sequence; identical to SEQ ID NO: 1581
  Description of Artificial Sequence: Synthetic signal sequence

SEQ ID NO: 5090 - DNA, 66 bp, Artificial Sequence; identical to SEQ ID NO: 1582
  Description of Artificial Sequence: Synthetic signal sequence

SEQ ID NO: 5091 - DNA, 66 bp, Artificial Sequence; identical to SEQ ID NO: 1583
  Description of Artificial Sequence: Synthetic signal sequence

SEQ ID NO: 5092 - DNA, 66 bp, Artificial Sequence; identical to SEQ ID NO: 1584
  Description of Artificial Sequence: Synthetic signal sequence

SEQ ID NO: 5093 - DNA, 66 bp, Artificial Sequence; identical to SEQ ID NO: 1585
  Description of Artificial Sequence: Synthetic signal sequence

SEQ ID NO: 5094 - DNA, 66 bp, Artificial Sequence; identical to SEQ ID NO: 1586
  Description of Artificial Sequence: Synthetic signal sequence

SEQ ID NO: 5095 - DNA, 66 bp, Artificial Sequence; identical to SEQ ID NO: 1587
  Description of Artificial Sequence: Synthetic signal sequence

SEQ ID NO: 5096 - DNA, 66 bp, Artificial Sequence; identical to SEQ ID NO: 1588
  Description of Artificial Sequence: Synthetic signal sequence

SEQ ID NO: 5097 - DNA, 918 bp, Artificial Sequence; identical to SEQ ID NO: 1590
  Description of Artificial Sequence: Synthetic payload

SEQ ID NO: 5098 - DNA, 918 bp, Artificial Sequence; identical to SEQ ID NO: 1591
  Description of Artificial Sequence: Synthetic payload

SEQ ID NO: 5099 - DNA, 918 bp, Artificial Sequence; identical to SEQ ID NO: 1591
  Description of Artificial Sequence: Synthetic payload

SEQ ID NO: 5100 - DNA, 921 bp, Artificial Sequence; identical to SEQ ID NO: 1593
  Description of Artificial Sequence: Synthetic payload

SEQ ID NO: 5101 - DNA, 918 bp, Artificial Sequence; identical to SEQ ID NO: 1594
  Description of Artificial Sequence: Synthetic payload

SEQ ID NO: 5102 - DNA, 918 bp, Artificial Sequence; identical to SEQ ID NO: 1595
  Description of Artificial Sequence: Synthetic payload

SEQ ID NO: 5103 - DNA, 918 bp, Artificial Sequence; identical to SEQ ID NO: 1596
  Description of Artificial Sequence: Synthetic payload

SEQ ID NO: 5104 - DNA, 918 bp, Artificial Sequence; identical to SEQ ID NO: 1597
  Description of Artificial Sequence: Synthetic payload

SEQ ID NO: 5105 - DNA, 918 bp, Artificial Sequence; identical to SEQ ID NO: 1590
  Description of Artificial Sequence: Synthetic payload

SEQ ID NO: 5106 - DNA, 918 bp, Artificial Sequence; identical to SEQ ID NO: 1591
  Description of Artificial Sequence: Synthetic payload

SEQ ID NO: 5107 - DNA, 918 bp, Artificial Sequence; identical to SEQ ID NO: 1600
  Description of Artificial Sequence: Synthetic payload

SEQ ID NO: 5108 - DNA, 918 bp, Artificial Sequence; identical to SEQ ID NO: 1601
  Description of Artificial Sequence: Synthetic payload

SEQ ID NO: 5109 - DNA, 918 bp, Artificial Sequence; identical to SEQ ID NO: 1602
  Description of Artificial Sequence: Synthetic payload

SEQ ID NO: 5110 - DNA, 594 bp, Artificial Sequence; identical to SEQ ID NO: 1604
  Description of Artificial Sequence: Synthetic payload

SEQ ID NO: 5111 - DNA, 594 bp, Artificial Sequence; identical to SEQ ID NO: 1605
  Description of Artificial Sequence: Synthetic payload

SEQ ID NO: 5112 - DNA, 594 bp, Artificial Sequence; identical to SEQ ID NO: 1606
  Description of Artificial Sequence: Synthetic payload

SEQ ID NO: 5113 - DNA, 594 bp, Artificial Sequence; identical to SEQ ID NO: 1607
  Description of Artificial Sequence: Synthetic payload

SEQ ID NO: 5114 - DNA, 591 bp, Artificial Sequence; identical to SEQ ID NO: 1608
  Description of Artificial Sequence: Synthetic payload

SEQ ID NO: 5115 - DNA, 591 bp, Artificial Sequence; identical to SEQ ID NO: 1609
  Description of Artificial Sequence: Synthetic payload

SEQ ID NO: 5116 - DNA, 594 bp, Artificial Sequence; identical to SEQ ID NO: 1610
  Description of Artificial Sequence: Synthetic payload

SEQ ID NO: 5117 - DNA, 597 bp, Artificial Sequence; identical to SEQ ID NO: 1611
  Description of Artificial Sequence: Synthetic payload

SEQ ID NO: 5118 - DNA, 597 bp, Artificial Sequence; identical to SEQ ID NO: 1612
  Description of Artificial Sequence: Synthetic payload

SEQ ID NO: 5119 - DNA, 591 bp, Artificial Sequence; identical to SEQ ID NO: 1613
  Description of Artificial Sequence: Synthetic payload

SEQ ID NO: 5120 - DNA, 591 bp, Artificial Sequence; identical to SEQ ID NO: 1614
  Description of Artificial Sequence: Synthetic payload

SEQ ID NO: 5121 - DNA, 345 bp, Homo sapiens; identical to SEQ ID NO: 168

SEQ ID NO: 5122 - DNA, 345 bp, Artificial Sequence; identical to SEQ ID NO: 1617
  Description of Artificial Sequence: Synthetic payload

SEQ ID NO: 5123 - DNA, 345 bp, Artificial Sequence; identical to SEQ ID NO: 1618
  Description of Artificial Sequence: Synthetic payload

SEQ ID NO: 5124 - DNA, 342 bp, Artificial Sequence; identical to SEQ ID NO: 1619
  Description of Artificial Sequence: Synthetic payload

SEQ ID NO: 5125 - DNA, 342 bp, Artificial Sequence; identical to SEQ ID NO: 1620
  Description of Artificial Sequence: Synthetic payload

SEQ ID NO: 5126 - DNA, 714 bp, Homo sapiens; identical to SEQ ID NO: 1622

SEQ ID NO: 5127 - DNA, 711 bp, Artificial Sequence; identical to SEQ ID NO: 1623
  Description of Artificial Sequence: Synthetic Construct

SEQ ID NO: 5128 - DNA, 711 bp, Artificial Sequence; identical to SEQ ID NO: 1624
  Description of Artificial Sequence: Synthetic payload

SEQ ID NO: 5129 - DNA, 705 bp, Artificial Sequence; identical to SEQ ID NO: 1626
  Description of Artificial Sequence: Synthetic polynucleotide

SEQ ID NO: 5130 - DNA, 576 bp, Artificial Sequence; identical to SEQ ID NO: 1627
  Description of Artificial Sequence: Synthetic Construct

SEQ ID NO: 5131 - DNA, 15 bp, Artificial Sequence
  Description of Artificial Sequence: Synthetic linker sequence
ggaggcagcggagga

SEQ ID NO: 5132 - DNA, 15 bp, Artificial Sequence
  Description of Artificial Sequence: Synthetic linker sequence
ggaggctctggagga

SEQ ID NO: 5133 - DNA, 15 bp, Artificial Sequence
  Description of Artificial Sequence: Synthetic linker sequence
ggaggctccggcgga

SEQ ID NO: 5134 - DNA, 15 bp, Artificial Sequence
  Description of Artificial Sequence: Synthetic linker sequence
ggaggatccggaggc

SEQ ID NO: 5135 - DNA, 15 bp, Artificial Sequence
  Description of Artificial Sequence: Synthetic linker sequence
ggaggatctggagga

SEQ ID NO: 5136 - DNA, 45 bp, Artificial Sequence; identical to SEQ ID NO: 1636
  Description of Artificial Sequence: Synthetic linker sequence

SEQ ID NO: 5137 - DNA, 45 bp, Artificial Sequence; identical to SEQ ID NO: 1637
  Description of Artificial Sequence: Synthetic linker sequence

SEQ ID NO: 5138 - DNA, 45 bp, Artificial Sequence; identical to SEQ ID NO: 1638
  Description of Artificial Sequence: Synthetic linker sequence

SEQ ID NO: 5139 - DNA, 45 bp, Artificial Sequence; identical to SEQ ID NO: 1639
  Description of Artificial Sequence: Synthetic linker sequence

SEQ ID NO: 5140 - DNA, 45 bp, Artificial Sequence; identical to SEQ ID NO: 1640
  Description of Artificial Sequence: Synthetic linker sequence

SEQ ID NO: 5141 - DNA, 45 bp, Artificial Sequence; identical to SEQ ID NO: 1641
  Description of Artificial Sequence: Synthetic linker sequence

SEQ ID NO: 5142 - DNA, 12 bp, Artificial Sequence
  Description of Artificial Sequence: Synthetic linker sequence
ggaggatctgga

SEQ ID NO: 5143 - DNA, 66 bp, Artificial Sequence; identical to SEQ ID NO: 1645
  Description of Artificial Sequence: Synthetic linker sequence

SEQ ID NO: 5144 - DNA, 78 bp, Artificial Sequence; identical to SEQ ID NO: 1647
  Description of Artificial Sequence: Synthetic linker sequence

SEQ ID NO: 5145 - DNA, 78 bp, Artificial Sequence; identical to SEQ ID NO: 1648
  Description of Artificial Sequence: Synthetic linker sequence

SEQ ID NO: 5146 - DNA, 78 bp, Artificial Sequence; identical to SEQ ID NO: 1649
  Description of Artificial Sequence: Synthetic linker sequence

SEQ ID NO: 5147 - DNA, 78 bp, Artificial Sequence; identical to SEQ ID NO: 1650
  Description of Artificial Sequence: Synthetic linker sequence

SEQ ID NO: 5148 - DNA, 78 bp, Artificial Sequence; identical to SEQ ID NO: 1651
  Description of Artificial Sequence: Synthetic linker sequence

SEQ ID NO: 5149 - DNA, 78 bp, Artificial Sequence; identical to SEQ ID NO: 1652
  Description of Artificial Sequence: Synthetic linker sequence

SEQ ID NO: 5150 - DNA, 78 bp, Artificial Sequence; identical to SEQ ID NO: 1650
  Description of Artificial Sequence: Synthetic linker sequence

SEQ ID NO: 5151 - DNA, 36 bp, Artificial Sequence; identical to SEQ ID NO: 1337
  Description of Artificial Sequence: Synthetic cleavage site

SEQ ID NO: 5152 - DNA, 36 bp, Artificial Sequence; identical to SEQ ID NO: 1338
  Description of Artificial Sequence: Synthetic cleavage site

SEQ ID NO: 5153 - DNA, 36 bp, Artificial Sequence; identical to SEQ ID NO: 1339
  Description of Artificial Sequence: Synthetic cleavage site

SEQ ID NO: 5154 - DNA, 27 bp, Artificial Sequence
  Description of Artificial Sequence: Synthetic HA Tag
tacccatacgatgttccagattacgct

SEQ ID NO: 5155 - DNA, 27 bp, Artificial Sequence
  Description of Artificial Sequence: Synthetic HA Tag
tatccttacgatgtgcccgactatgct

SEQ ID NO: 5156 - DNA, 27 bp, Artificial Sequence
  Description of Artificial Sequence: Synthetic HA Tag
tatccgtacgacgtaccagactacgca

SEQ ID NO: 5157 - DNA, 321 bp, Artificial Sequence; identical to SEQ ID NO: 1664
  Description of Artificial Sequence: Synthetic destabilizing domain (DD)

SEQ ID NO: 5158 - DNA, 321 bp, Artificial Sequence; identical to SEQ ID NO: 1665
  Description of Artificial Sequence: Synthetic destabilizing domain (DD)

SEQ ID NO: 5159 - DNA, 321 bp, Artificial Sequence; identical to SEQ ID NO: 1666
  Description of Artificial Sequence: Synthetic destabilizing domain (DD)

SEQ ID NO: 5160 - DNA, 321 bp, Artificial Sequence; identical to SEQ ID NO: 1667
  Description of Artificial Sequence: Synthetic destabilizing domain (DD)

SEQ ID NO: 5161 - DNA, 321 bp, Artificial Sequence; identical to SEQ ID NO: 1668
  Description of Artificial Sequence: Synthetic destabilizing domain (DD)

SEQ ID NO: 5162 - DNA, 324 bp, Artificial Sequence; identical to SEQ ID NO: 1669
  Description of Artificial Sequence: Synthetic destabilizing domain (DD)

SEQ ID NO: 5163 - DNA, 324 bp, Artificial Sequence; identical to SEQ ID NO: 1670
  Description of Artificial Sequence: Synthetic destabilizing domain (DD)

SEQ ID NO: 5164 - DNA, 324 bp, Artificial Sequence; identical to SEQ ID NO: 1671
  Description of Artificial Sequence: Synthetic destabilizing domain (DD)

SEQ ID NO: 5165 - DNA, 324 bp, Artificial Sequence; identical to SEQ ID NO: 1672
  Description of Artificial Sequence: Synthetic destabilizing domain (DD)

SEQ ID NO: 5166 - DNA, 321 bp, Artificial Sequence; identical to SEQ ID NO: 1673
  Description of Artificial Sequence: Synthetic destabilizing domain (DD)

SEQ ID NO: 5167 - DNA, 321 bp, Artificial Sequence; identical to SEQ ID NO: 1674
  Description of Artificial Sequence: Synthetic destabilizing domain (DD)

SEQ ID NO: 5168 - DNA, 474 bp, Artificial Sequence; identical to SEQ ID NO: 1676
  Description of Artificial Sequence: Synthetic destabilizing domain (DD)

SEQ ID NO: 5169 - DNA, 477 bp, Artificial Sequence; identical to SEQ ID NO: 1677
  Description of Artificial Sequence: Synthetic destabilizing domain (DD)

SEQ ID NO: 5170 - DNA, 474 bp, Artificial Sequence; identical to SEQ ID NO: 1678
  Description of Artificial Sequence: Synthetic destabilizing domain (DD)

SEQ ID NO: 5171 - DNA, 474 bp, Artificial Sequence; identical to SEQ ID NO: 1679
  Description of Artificial Sequence: Synthetic destabilizing domain (DD)

SEQ ID NO: 5172 - DNA, 474 bp, Artificial Sequence; identical to SEQ ID NO: 1680
  Description of Artificial Sequence: Synthetic destabilizing domain (DD)

SEQ ID NO: 5173 - DNA, 474 bp, Artificial Sequence; identical to SEQ ID NO: 1681
  Description of Artificial Sequence: Synthetic destabilizing domain (DD)

SEQ ID NO: 5174 - DNA, 477 bp, Artificial Sequence; identical to SEQ ID NO: 1682
  Description of Artificial Sequence: Synthetic destabilizing domain (DD)

SEQ ID NO: 5175 - DNA, 474 bp, Artificial Sequence; identical to SEQ ID NO: 1683
  Description of Artificial Sequence: Synthetic destabilizing domain (DD)

SEQ ID NO: 5176 - DNA, 474 bp, Artificial Sequence; identical to SEQ ID NO: 1684
  Description of Artificial Sequence: Synthetic destabilizing domain (DD)

SEQ ID NO: 5177 - DNA, 558 bp, Artificial Sequence; identical to SEQ ID NO: 1685
  Description of Artificial Sequence: Synthetic destabilizing domain (DD)

SEQ ID NO: 5178 - DNA, 558 bp, Artificial Sequence; identical to SEQ ID NO: 1686
  Description of Artificial Sequence: Synthetic destabilizing domain (DD)

SEQ ID NO: 5179 - DNA, 561 bp, Artificial Sequence; identical to SEQ ID NO: 77
  Description of Artificial Sequence: Synthetic destabilizing domain (DD)

SEQ ID NO: 5180 - DNA, 561 bp, Artificial Sequence; identical to SEQ ID NO: 1688
  Description of Artificial Sequence: Synthetic destabilizing domain (DD)

SEQ ID NO: 5181 - DNA, 558 bp, Artificial Sequence; identical to SEQ ID NO: 1689
  Description of Artificial Sequence: Synthetic destabilizing domain (DD)

SEQ ID NO: 5182 - DNA, 558 bp, Artificial Sequence; identical to SEQ ID NO: 1690
  Description of Artificial Sequence: Synthetic destabilizing domain (DD)

SEQ ID NO: 5183 - DNA, 561 bp, Artificial Sequence; identical to SEQ ID NO: 83
  Description of Artificial Sequence: Synthetic destabilizing domain (DD)

SEQ ID NO: 5184 - DNA, 558 bp, Artificial Sequence; identical to SEQ ID NO: 1692
  Description of Artificial Sequence: Synthetic destabilizing domain (DD)

SEQ ID NO: 5185 - DNA, 561 bp, Artificial Sequence; identical to SEQ ID NO: 85
  Description of Artificial Sequence: Synthetic destabilizing domain (DD)

SEQ ID NO: 5186 - DNA, 561 bp, Artificial Sequence; identical to SEQ ID NO: 1694
  Description of Artificial Sequence: Synthetic destabilizing domain (DD)

SEQ ID NO: 5187 - DNA, 558 bp, Artificial Sequence; identical to SEQ ID NO: 1695
  Description of Artificial Sequence: Synthetic destabilizing domain (DD)

SEQ ID NO: 5188 - DNA, 558 bp, Artificial Sequence; identical to SEQ ID NO: 1696
  Description of Artificial Sequence: Synthetic destabilizing domain (DD)

SEQ ID NO: 5189 - DNA, 321 bp, Artificial Sequence; identical to SEQ ID NO: 1675
  Description of Artificial Sequence: Synthetic destabilizing domain (DD)

SEQ ID NO: 5190 - DNA, 1461 bp, Artificial Sequence; identical to SEQ ID NO: 1697
  Description of Artificial Sequence: Synthetic Construct

SEQ ID NO: 5191 - DNA, 1782 bp, Artificial Sequence; identical to SEQ ID NO: 1698
  Description of Artificial Sequence: Synthetic Construct

SEQ ID NO: 5192 - DNA, 1935 bp, Artificial Sequence; identical to SEQ ID NO: 1699
  Description of Artificial Sequence: Synthetic Construct

SEQ ID NO: 5193 - DNA, 1782 bp, Artificial Sequence; identical to SEQ ID NO: 1700
  Description of Artificial Sequence: Synthetic Construct

SEQ ID NO: 5194 - DNA, 1935 bp, Artificial Sequence; identical to SEQ ID NO: 1701
  Description of Artificial Sequence: Synthetic Construct

SEQ ID NO: 5195 - DNA, 1950 bp, Artificial Sequence; identical to SEQ ID NO: 1702
  Description of Artificial Sequence: Synthetic Construct

SEQ ID NO: 5196 - DNA, 1797 bp, Artificial Sequence; identical to SEQ ID NO: 1703
  Description of Artificial Sequence: Synthetic Construct

SEQ ID NO: 5197 - DNA, 2034 bp, Artificial Sequence; identical to SEQ ID NO: 165
  Description of Artificial Sequence: Synthetic Construct

SEQ ID NO: 5198 - DNA, 2034 bp, Artificial Sequence; identical to SEQ ID NO: 166
  Description of Artificial Sequence: Synthetic Construct

SEQ ID NO: 5199 - DNA, 2034 bp, Artificial Sequence; identical to SEQ ID NO: 167
  Description of Artificial Sequence: Synthetic Construct

SEQ ID NO: 5200 - DNA, 2034 bp, Artificial Sequence; identical to SEQ ID NO: 1707
  Description of Artificial Sequence: Synthetic Construct

SEQ ID NO: 5201 - DNA, 1824 bp, Artificial Sequence; identical to SEQ ID NO: 1708
  Description of Artificial Sequence: Synthetic Construct

SEQ ID NO: 5202 - DNA, 1977 bp, Artificial Sequence; identical to SEQ ID NO: 1709
  Description of Artificial Sequence: Synthetic Construct

SEQ ID NO: 5203 - DNA, 2061 bp, Artificial Sequence; identical to SEQ ID NO: 176
  Description of Artificial Sequence: Synthetic Construct

SEQ ID NO: 5204 - DNA, 2061 bp, Artificial Sequence; identical to SEQ ID NO: 177
  Description of Artificial Sequence: Synthetic Construct

SEQ ID NO: 5205 - DNA, 2034 bp, Artificial Sequence; identical to SEQ ID NO: 165
  Description of Artificial Sequence: Synthetic polynucleotide

SEQ ID NO: 5206 - DNA, 1467 bp, Artificial Sequence; identical to SEQ ID NO: 1713
  Description of Artificial Sequence: Synthetic polynucleotide

SEQ ID NO: 5207 - DNA, 1527 bp, Artificial Sequence; identical to SEQ ID NO: 1714
  Description of Artificial Sequence: Synthetic polynucleotide

SEQ ID NO: 5208 - DNA, 1494 bp, Artificial Sequence; identical to SEQ ID NO: 1715
  Description of Artificial Sequence: Synthetic polynucleotide

SEQ ID NO: 5209 - DNA, 1509 bp, Artificial Sequence; identical to SEQ ID NO: 1716
  Description of Artificial Sequence: Synthetic polynucleotide

SEQ ID NO: 5210 - DNA, 1461 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 5211 - DNA, 3158 bp, Artificial Sequence; identical to SEQ ID NO: 1718
  Description of Artificial Sequence: Synthetic polynucleotide

SEQ ID NO: 5212 - DNA, 2232 bp, Artificial Sequence; identical to SEQ ID NO: 1719
  Description of Artificial Sequence: Synthetic polynucleotide

SEQ ID NO: 5213 - DNA, 2658 bp, Artificial Sequence; identical to SEQ ID NO: 1720
  Description of Artificial Sequence: Synthetic polynucleotide

SEQ ID NO: 5214 - DNA, 2724 bp, Artificial Sequence; identical to SEQ ID NO: 1721
  Description of Artificial Sequence: Synthetic polynucleotide

SEQ ID NO: 5215 - DNA, 2712 bp, Artificial Sequence; identical to SEQ ID NO: 1722
  Description of Artificial Sequence: Synthetic polynucleotide

SEQ ID NO: 5216 - DNA, 90 bp, Artificial Sequence; identical to SEQ ID NO: 1724
  Description of Artificial Sequence: Synthetic Leader sequence

SEQ ID NO: 5217 - DNA, 12 bp, Artificial Sequence
  Description of Artificial Sequence: Synthetic Linker sequence
gctagcttcgaa

SEQ ID NO: 5218 - DNA, 126 bp, Homo sapiens; identical to SEQ ID NO: 1731

SEQ ID NO: 5219 - DNA, 729 bp, Artificial Sequence; identical to SEQ ID NO: 1733
  Description of Artificial Sequence: Synthetic Construct

SEQ ID NO: 5220 - DNA, 135 bp, Artificial Sequence; identical to SEQ ID NO: 1735
  Description of Artificial Sequence: Synthetic Construct

SEQ ID NO: 5221 - DNA, 72 bp, Artificial Sequence; identical to SEQ ID NO: 1737
  Description of Artificial Sequence: Synthetic Construct

SEQ ID NO: 5222 - DNA, 336 bp, Homo sapiens; identical to SEQ ID NO: 1739

SEQ ID NO: 5223 - DNA, 558 bp, Artificial Sequence; identical to SEQ ID NO: 1685
  Description of Artificial Sequence: Synthetic Destabilizing Domain (DD)

SEQ ID NO: 5224 - DNA, 558 bp, Artificial Sequence; identical to SEQ ID NO: 1686
  Description of Artificial Sequence: Synthetic Destabilizing Domain (DD)

SEQ ID NO: 5225 - DNA, 558 bp, Artificial Sequence; identical to SEQ ID NO: 1692
  Description of Artificial Sequence: Synthetic Destabilizing Domain (DD)

SEQ ID NO: 5226 - protein, 686 aa, Artificial Sequence; identical to SEQ ID NO: 1171
  Description of Artificial Sequence: Synthetic Construct

SEQ ID NO: 5227 - DNA, 2061 bp, Artificial Sequence; identical to SEQ ID NO: 1744
  Description of Artificial Sequence: Synthetic Construct

SEQ ID NO: 5228 - DNA, 738 bp, Artificial Sequence; identical to SEQ ID NO: 1746
  Description of Artificial Sequence: Synthetic scFV sequence

SEQ ID NO: 5229 - DNA, 207 bp, Homo sapiens; identical to SEQ ID NO: 1748

SEQ ID NO: 5230 - DNA, 336 bp, Homo sapiens; identical to SEQ ID NO: 1739

SEQ ID NO: 5231 - DNA, 126 bp, Homo sapiens; identical to SEQ ID NO: 1731

SEQ ID NO: 5232 - DNA, 63 bp, Homo sapiens; identical to SEQ ID NO: 1321

SEQ ID NO: 5233 - DNA, 63 bp, Artificial Sequence; identical to SEQ ID NO: 1322
  Description of Artificial Sequence: Synthetic Signal Sequence

SEQ ID NO: 5234 - DNA, 63 bp, Artificial Sequence; identical to SEQ ID NO: 1323
  Description of Artificial Sequence: Synthetic Signal Sequence

SEQ ID NO: 5235 - DNA, 63 bp, Artificial Sequence; identical to SEQ ID NO: 1324
  Description of Artificial Sequence: Synthetic Signal Sequence

SEQ ID NO: 5236 - DNA, 63 bp, Artificial Sequence; identical to SEQ ID NO: 1325
  Description of Artificial Sequence: Synthetic Signal Sequence

SEQ ID NO: 5237 - DNA, 63 bp, Artificial Sequence; identical to SEQ ID NO: 1754
  Description of Artificial Sequence: Synthetic Leader sequence

SEQ ID NO: 5238 - DNA, 474 bp, Artificial Sequence; identical to SEQ ID NO: 1678
  Description of Artificial Sequence: Synthetic Destabilizing Domain (DD)

SEQ ID NO: 5239 - DNA, 474 bp, Artificial Sequence; identical to SEQ ID NO: 1676
  Description of Artificial Sequence: Synthetic Destabilizing Domain (DD)

SEQ ID NO: 5240 - DNA, 477 bp, Artificial Sequence; identical to SEQ ID NO: 1677
  Description of Artificial Sequence: Synthetic Destabilizing Domain (DD)

SEQ ID NO: 5241 - DNA, 474 bp, Artificial Sequence; identical to SEQ ID NO: 1678
  Description of Artificial Sequence: Synthetic Destabilizing Domain (DD)

SEQ ID NO: 5242 - DNA, 474 bp, Artificial Sequence; identical to SEQ ID NO: 1679
  Description of Artificial Sequence: Synthetic Destabilizing Domain (DD)

SEQ ID NO: 5243 - DNA, 474 bp, Artificial Sequence; identical to SEQ ID NO: 1680
  Description of Artificial Sequence: Synthetic Destabilizing Domain (DD)

SEQ ID NO: 5244 - DNA, 474 bp, Artificial Sequence; identical to SEQ ID NO: 1681
  Description of Artificial Sequence: Synthetic Destabilizing Domain (DD)

SEQ ID NO: 5245 - DNA, 321 bp, Artificial Sequence; identical to SEQ ID NO: 1764
  Description of Artificial Sequence: Synthetic Destabilizing Domain (DD)

SEQ ID NO: 5246 - DNA, 324 bp, Artificial Sequence; identical to SEQ ID NO: 1669
  Description of Artificial Sequence: Synthetic Destabilizing Domain (DD)

SEQ ID NO: 5247 - DNA, 324 bp, Artificial Sequence; identical to SEQ ID NO: 1670
  Description of Artificial Sequence: Synthetic Destabilizing Domain (DD)

SEQ ID NO: 5248 - DNA, 324 bp, Artificial Sequence; identical to SEQ ID NO: 1671
  Description of Artificial Sequence: Synthetic Destabilizing Domain (DD)

SEQ ID NO: 5249 - DNA, 324 bp, Artificial Sequence; identical to SEQ ID NO: 1672
  Description of Artificial Sequence: Synthetic Destabilizing Domain (DD)

SEQ ID NO: 5250 - DNA, 321 bp, Artificial Sequence; identical to SEQ ID NO: 1673
  Description of Artificial Sequence: Synthetic Destabilizing Domain (DD)

SEQ ID NO: 5251 - DNA, 321 bp, Artificial Sequence; identical to SEQ ID NO: 1674
  Description of Artificial Sequence: Synthetic Destabilizing Domain (DD)

SEQ ID NO: 5252 - DNA, 321 bp, Artificial Sequence; identical to SEQ ID NO: 1675
  Description of Artificial Sequence: Synthetic Destabilizing Domain (DD)

SEQ ID NO: 5253 - DNA, 1473 bp, Artificial Sequence; identical to SEQ ID NO: 1772
  Description of Artificial Sequence: Synthetic Construct

SEQ ID NO: 5254 - DNA, 1800 bp, Artificial Sequence; identical to SEQ ID NO: 1773
  Description of Artificial Sequence: Synthetic Construct

SEQ ID NO: 5255 - DNA, 1953 bp, Artificial Sequence; identical to SEQ ID NO: 1774
  Description of Artificial Sequence: Synthetic Construct

SEQ ID NO: 5256 - DNA, 60 bp, Artificial Sequence; identical to SEQ ID NO: 1776
  Description of Artificial Sequence: Synthetic Signal Sequence

SEQ ID NO: 5257 - DNA, 60 bp, Homo sapiens; identical to SEQ ID NO: 1777

SEQ ID NO: 5258 - DNA, 60 bp, Artificial Sequence; identical to SEQ ID NO: 1778
  Description of Artificial Sequence: Synthetic Signal Sequence

SEQ ID NO: 5259 - DNA, 60 bp, Artificial Sequence; identical to SEQ ID NO: 1779
  Description of Artificial Sequence: Synthetic Signal Sequence

SEQ ID NO: 5260 - DNA, 18 bp, Artificial Sequence
  Description of Artificial Sequence: Synthetic Linker sequence
gagttcagcaccgagttt

SEQ ID NO: 5261 - DNA, 402 bp, Artificial Sequence; identical to SEQ ID NO: 1783
  Description of Artificial Sequence: Synthetic Construct

SEQ ID NO: 5262 - DNA, 402 bp, Homo sapiens; identical to SEQ ID NO: 1784

SEQ ID NO: 5263 - DNA, 321 bp, Artificial Sequence; identical to SEQ ID NO: 1786
  Description of Artificial Sequence: Synthetic Destabilizing Domain (DD)

SEQ ID NO: 5264 - DNA, 321 bp, Artificial Sequence; identical to SEQ ID NO: 1664
  Description of Artificial Sequence: Synthetic Destabilizing Domain (DD)

SEQ ID NO: 5265 - DNA, 321 bp, Artificial Sequence; identical to SEQ ID NO: 1665
  Description of Artificial Sequence: Synthetic Destabilizing Domain (DD)

SEQ ID NO: 5266 - DNA, 321 bp, Artificial Sequence; identical to SEQ ID NO: 1666
  Description of Artificial Sequence: Synthetic Destabilizing Domain (DD)

SEQ ID NO: 5267 - DNA, 321 bp, Artificial Sequence; identical to SEQ ID NO: 1667
  Description of Artificial Sequence: Synthetic Destabilizing Domain (DD)

SEQ ID NO: 5268 - DNA, 321 bp, Artificial Sequence; identical to SEQ ID NO: 1668
  Description of Artificial Sequence: Synthetic Destabilizing Domain (DD)

SEQ ID NO: 5269 - DNA, 807 bp, Artificial Sequence; identical to SEQ ID NO: 1792
  Description of Artificial Sequence: Synthetic Construct

SEQ ID NO: 5270 - DNA, 462 bp, Artificial Sequence; identical to SEQ ID NO: 1793
  Description of Artificial Sequence: Synthetic Construct

SEQ ID NO: 5271 - DNA, 960 bp, Artificial Sequence; identical to SEQ ID NO: 1794
  Description of Artificial Sequence: Synthetic Construct

SEQ ID NO: 5272 - protein, 133 aa, Homo sapiens [sequence omitted]

SEQ ID NO: 5273 - DNA, 603 bp, Artificial Sequence; identical to SEQ ID NO: 1795
  Description of Artificial Sequence: Synthetic promoter

SEQ ID NO: 5274 - DNA, 1339 bp, Artificial Sequence; identical to SEQ ID NO: 1796
  Description of Artificial Sequence: Synthetic promoter

SEQ ID NO: 5275 - DNA, 399 bp, Artificial Sequence; identical to SEQ ID NO: 1797
  Description of Artificial Sequence: Synthetic promoter

SEQ ID NO: 5276 - DNA, 15 bp, Artificial Sequence
  Description of Artificial Sequence: Synthetic linker sequence
tcaggcggggggagt

SEQ ID NO: 5277 - DNA, 66 bp, Homo sapiens; identical to SEQ ID NO: 1580

SEQ ID NO: 5278 - DNA, 66 bp, Artificial Sequence; identical to SEQ ID NO: 1581
  Description of Artificial Sequence: Synthetic signal sequence

SEQ ID NO: 5279 - DNA, 66 bp, Artificial Sequence; identical to SEQ ID NO: 1582
  Description of Artificial Sequence: Synthetic signal sequence

SEQ ID NO: 5280 - DNA, 66 bp, Artificial Sequence; identical to SEQ ID NO: 1583
  Description of Artificial Sequence: Synthetic signal sequence

SEQ ID NO: 5281 - DNA, 66 bp, Artificial Sequence; identical to SEQ ID NO: 1584
  Description of Artificial Sequence: Synthetic signal sequence

SEQ ID NO: 5282 - DNA, 66 bp, Artificial Sequence; identical to SEQ ID NO: 1585
  Description of Artificial Sequence: Synthetic signal sequence

SEQ ID NO: 5283 - DNA, 66 bp, Artificial Sequence; identical to SEQ ID NO: 1586
  Description of Artificial Sequence: Synthetic signal sequence

SEQ ID NO: 5284 - DNA, 66 bp, Artificial Sequence; identical to SEQ ID NO: 1587
  Description of Artificial Sequence: Synthetic signal sequence

SEQ ID NO: 5285 - DNA, 66 bp, Artificial Sequence; identical to SEQ ID NO: 1588
  Description of Artificial Sequence: Synthetic signal sequence

SEQ ID NO: 5286 - DNA, 15 bp, Artificial Sequence
  Description of Artificial Sequence: Synthetic linker sequence
ggaggatccggaggc

SEQ ID NO: 5287 - DNA, 15 bp, Artificial Sequence
  Description of Artificial Sequence: Synthetic linker sequence
ggaggatctggagga

SEQ ID NO: 5288 - DNA, 45 bp, Artificial Sequence; identical to SEQ ID NO: 1636
  Description of Artificial Sequence: Synthetic linker sequence

SEQ ID NO: 5289 - DNA, 45 bp, Artificial Sequence; identical to SEQ ID NO: 1637
  Description of Artificial Sequence: Synthetic linker sequence

SEQ ID NO: 5290 - DNA, 45 bp, Artificial Sequence; identical to SEQ ID NO: 1638
  Description of Artificial Sequence: Synthetic linker sequence

SEQ ID NO: 5291 - DNA, 45 bp, Artificial Sequence; identical to SEQ ID NO: 1639
  Description of Artificial Sequence: Synthetic linker sequence

SEQ ID NO: 5292 - DNA, 45 bp, Artificial Sequence; identical to SEQ ID NO: 1640
  Description of Artificial Sequence: Synthetic linker sequence

SEQ ID NO: 5293 - DNA, 45 bp, Artificial Sequence; identical to SEQ ID NO: 1641
  Description of Artificial Sequence: Synthetic linker sequence

SEQ ID NO: 5294 - DNA, 57 bp, Artificial Sequence; identical to SEQ ID NO: 1800
  Description of Artificial Sequence: Synthetic spacer

SEQ ID NO: 5295 - DNA, 27 bp, Homo sapiens
agcgccaggaatcgccagaagcggtcc

SEQ ID NO: 5296 - DNA, 24 bp, Homo sapiens
gcccggaatagacagaagagatct

SEQ ID NO: 5297 - DNA, 36 bp, Artificial Sequence; identical to SEQ ID NO: 1337
  Description of Artificial Sequence: Synthetic cleavage site

SEQ ID NO: 5298 - DNA, 36 bp, Artificial Sequence; identical to SEQ ID NO: 1338
  Description of Artificial Sequence: Synthetic cleavage site

SEQ ID NO: 5299 - DNA, 36 bp, Artificial Sequence; identical to SEQ ID NO: 1339
  Description of Artificial Sequence: Synthetic cleavage site

SEQ ID NO: 5300 - DNA, 60 bp, Artificial Sequence; identical to SEQ ID NO: 1806
  Description of Artificial Sequence: Synthetic cleavable peptide

SEQ ID NO: 5301 - DNA, 921 bp, Artificial Sequence; identical to SEQ ID NO: 1593
  Description of Artificial Sequence: Synthetic payload

SEQ ID NO: 5302 - DNA, 918 bp, Artificial Sequence; identical to SEQ ID NO: 1594
  Description of Artificial Sequence: Synthetic payload

SEQ ID NO: 5303 - DNA, 918 bp, Artificial Sequence; identical to SEQ ID NO: 1595
  Description of Artificial Sequence: Synthetic payload

SEQ ID NO: 5304 - DNA, 918 bp, Artificial Sequence; identical to SEQ ID NO: 1596
  Description of Artificial Sequence: Synthetic payload

SEQ ID NO: 5305 - DNA, 918 bp, Artificial Sequence; identical to SEQ ID NO: 1597
  Description of Artificial Sequence: Synthetic payload

SEQ ID NO: 5306 - DNA, 918 bp, Artificial Sequence; identical to SEQ ID NO: 1590
  Description of Artificial Sequence: Synthetic payload

SEQ ID NO: 5307 - DNA, 918 bp, Artificial Sequence; identical to SEQ ID NO: 1591
  Description of Artificial Sequence: Synthetic payload

SEQ ID NO: 5308 - DNA, 918 bp, Artificial Sequence; identical to SEQ ID NO: 1600
  Description of Artificial Sequence: Synthetic payload

SEQ ID NO: 5309 - DNA, 918 bp, Artificial Sequence; identical to SEQ ID NO: 1601
  Description of Artificial Sequence: Synthetic payload

SEQ ID NO: 5310 - DNA, 918 bp, Artificial Sequence; identical to SEQ ID NO: 1602
  Description of Artificial Sequence: Synthetic payload

SEQ ID NO: 5311 - DNA, 918 bp, Artificial Sequence; identical to SEQ ID NO: 1590
  Description of Artificial Sequence: Synthetic payload

SEQ ID NO: 5312 - DNA, 918 bp, Artificial Sequence; identical to SEQ ID NO: 1591
  Description of Artificial Sequence: Synthetic payload

SEQ ID NO: 5313 - DNA, 918 bp, Artificial Sequence; identical to SEQ ID NO: 1591
  Description of Artificial Sequence: Synthetic payload

SEQ ID NO: 5314 - DNA, 918 bp, Artificial Sequence; identical to SEQ ID NO: 1808
  Description of Artificial Sequence: Synthetic payload

SEQ ID NO: 5315 - DNA, 594 bp, Artificial Sequence; identical to SEQ ID NO: 1604
  Description of Artificial Sequence: Synthetic payload

SEQ ID NO: 5316 - DNA, 594 bp, Artificial Sequence; identical to SEQ ID NO: 1605
  Description of Artificial Sequence: Synthetic payload

SEQ ID NO: 5317 - DNA, 594 bp, Artificial Sequence; identical to SEQ ID NO: 1606
  Description of Artificial Sequence: Synthetic payload

SEQ ID NO: 5318 - DNA, 594 bp, Artificial Sequence; identical to SEQ ID NO: 1607
  Description of Artificial Sequence: Synthetic payload

SEQ ID NO: 5319 - DNA, 591 bp, Artificial Sequence; identical to SEQ ID NO: 1608
  Description of Artificial Sequence: Synthetic payload

SEQ ID NO: 5320 - DNA, 591 bp, Artificial Sequence; identical to SEQ ID NO: 1609
  Description of Artificial Sequence: Synthetic payload

SEQ ID NO: 5321 - DNA, 594 bp, Artificial Sequence; identical to SEQ ID NO: 1610
  Description of Artificial Sequence: Synthetic payload

SEQ ID NO: 5322 - DNA, 597 bp, Artificial Sequence; identical to SEQ ID NO: 1611
  Description of Artificial Sequence: Synthetic payload

SEQ ID NO: 5323 - DNA, 597 bp, Artificial Sequence; identical to SEQ ID NO: 1612
  Description of Artificial Sequence: Synthetic payload

SEQ ID NO: 5324 - DNA, 591 bp, Artificial Sequence; identical to SEQ ID NO: 1613
  Description of Artificial Sequence: Synthetic payload

SEQ ID NO: 5325 - DNA, 591 bp, Artificial Sequence; identical to SEQ ID NO: 1614
  Description of Artificial Sequence: Synthetic payload

SEQ ID NO: 5326 - protein, 197 aa, Homo sapiens; identical to SEQ ID NO: 735

SEQ ID NO: 5327 - DNA, 594 bp, Homo sapiens; identical to SEQ ID NO: 1604

SEQ ID NO: 5328 - DNA, 594 bp, Artificial Sequence; identical to SEQ ID NO: 1606
  Description of Artificial Sequence: Synthetic construct

SEQ ID NO: 5329 - DNA, 594 bp, Artificial Sequence; identical to SEQ ID NO: 1606
  Description of Artificial Sequence: Synthetic construct

SEQ ID NO: 5330 - DNA, 594 bp, Artificial Sequence; identical to SEQ ID NO: 1607
  Description of Artificial Sequence: Synthetic construct

SEQ ID NO: 5331 - DNA, 591 bp, Artificial Sequence; identical to SEQ ID NO: 1608
  Description of Artificial Sequence: Synthetic construct

SEQ ID NO: 5332 - DNA, 591 bp, Artificial Sequence; identical to SEQ ID NO: 1609
  Description of Artificial Sequence: Synthetic construct

SEQ ID NO: 5333 - DNA, 594 bp, Artificial Sequence; identical to SEQ ID NO: 1610
  Description of Artificial Sequence: Synthetic construct

SEQ ID NO: 5334 - DNA, 597 bp, Artificial Sequence; identical to SEQ ID NO: 1611
  Description of Artificial Sequence: Synthetic construct

SEQ ID NO: 5335 - DNA, 597 bp, Artificial Sequence; identical to SEQ ID NO: 1612
  Description of Artificial Sequence: Synthetic construct

SEQ ID NO: 5336 - DNA, 591 bp, Artificial Sequence; identical to SEQ ID NO: 1613
  Description of Artificial Sequence: Synthetic construct

SEQ ID NO: 5337 - protein, 158 aa, Artificial Sequence; identical to SEQ ID NO: 1174
  Description of Artificial Sequence: Synthetic destabilizing domain (DD)

SEQ ID NO: 5338 - DNA, 474 bp, Artificial Sequence; identical to SEQ ID NO: 1676
  Description of Artificial Sequence: Synthetic destabilizing domain (DD)

SEQ ID NO: 5339 - DNA, 477 bp, Artificial Sequence; identical to SEQ ID NO: 1677
  Description of Artificial Sequence: Synthetic destabilizing domain (DD)

SEQ ID NO: 5340 - DNA, 474 bp, Artificial Sequence; identical to SEQ ID NO: 1678
  Description of Artificial Sequence: Synthetic destabilizing domain (DD)

SEQ ID NO: 5341 - DNA, 474 bp, Artificial Sequence; identical to SEQ ID NO: 1679
  Description of Artificial Sequence: Synthetic destabilizing domain (DD)

SEQ ID NO: 5342 - DNA, 474 bp, Artificial Sequence; identical to SEQ ID NO: 1680
  Description of Artificial Sequence: Synthetic destabilizing domain (DD)

SEQ ID NO: 5343 - DNA, 474 bp, Artificial Sequence; identical to SEQ ID NO: 1681
  Description of Artificial Sequence: Synthetic destabilizing domain (DD)

SEQ ID NO: 5344 - protein, 107 aa, Artificial Sequence; identical to SEQ ID NO: 1176
  Description of Artificial Sequence: Synthetic destabilizing domain (DD)

SEQ ID NO: 5345 - DNA, 321 bp, Artificial Sequence; identical to SEQ ID NO: 1664
  Description of Artificial Sequence: Synthetic destabilizing domain (DD)

SEQ ID NO: 5346 - DNA, 321 bp, Artificial Sequence; identical to SEQ ID NO: 1665
  Description of Artificial Sequence: Synthetic destabilizing domain (DD)

SEQ ID NO: 5347 - DNA, 321 bp, Artificial Sequence; identical to SEQ ID NO: 1666
  Description of Artificial Sequence: Synthetic destabilizing domain (DD)

SEQ ID NO: 5348 - DNA, 321 bp, Artificial Sequence; identical to SEQ ID NO: 1667
  Description of Artificial Sequence: Synthetic destabilizing domain (DD)

SEQ ID NO: 5349 - DNA, 321 bp, Artificial Sequence; identical to SEQ ID NO: 1668
  Description of Artificial Sequence: Synthetic destabilizing domain (DD)

SEQ ID NO: 5350 - protein, 107 aa, Artificial Sequence; identical to SEQ ID NO: 1177
  Description of Artificial Sequence: Synthetic destabilizing domain (DD)

SEQ ID NO: 5351 - DNA, 324 bp, Artificial Sequence; identical to SEQ ID NO: 1669
  Description of Artificial Sequence: Synthetic destabilizing domain (DD)

SEQ ID NO: 5352 - DNA, 324 bp, Artificial Sequence; identical to SEQ ID NO: 1670
  Description of Artificial Sequence: Synthetic destabilizing domain (DD)

SEQ ID NO: 5353 - DNA, 324 bp, Artificial Sequence; identical to SEQ ID NO: 1671
  Description of Artificial Sequence: Synthetic destabilizing domain (DD)

SEQ ID NO: 5354 - DNA, 324 bp, Artificial Sequence; identical to SEQ ID NO: 1672
  Description of Artificial Sequence: Synthetic destabilizing domain (DD)

SEQ ID NO: 5355 - DNA, 321 bp, Artificial Sequence; identical to SEQ ID NO: 1673
  Description of Artificial Sequence: Synthetic destabilizing domain (DD)

SEQ ID NO: 5356 - DNA, 321 bp, Artificial Sequence; identical to SEQ ID NO: 1674
  Description of Artificial Sequence: Synthetic destabilizing domain (DD)

SEQ ID NO: 5357 - DNA, 321 bp, Artificial Sequence; identical to SEQ ID NO: 1675
  Description of Artificial Sequence: Synthetic destabilizing domain (DD)

SEQ ID NO: 5358 - DNA, 558 bp, Artificial Sequence; identical to SEQ ID NO: 86
  Description of Artificial Sequence: Synthetic destabilizing domain (DD)

SEQ ID NO: 5359 - DNA, 558 bp, Artificial Sequence; identical to SEQ ID NO: 1820
  Description of Artificial Sequence: Synthetic destabilizing domain (DD)

SEQ ID NO: 5360 - DNA, 558 bp, Artificial Sequence; identical to SEQ ID NO: 1685
  Description of Artificial Sequence: Synthetic destabilizing domain (DD)

SEQ ID NO: 5361 - DNA, 558 bp, Artificial Sequence; identical to SEQ ID NO: 1686
  Description of Artificial Sequence: Synthetic destabilizing domain (DD)

SEQ ID NO: 5362 - DNA, 1959 bp, Artificial Sequence; identical to SEQ ID NO: 1822
  Description of Artificial Sequence: Synthetic construct

SEQ ID NO: 5363 - DNA, 1962 bp, Artificial Sequence; identical to SEQ ID NO: 1824
  Description of Artificial Sequence: Synthetic construct

SEQ ID NO: 5364 - DNA, 1971 bp, Artificial Sequence; identical to SEQ ID NO: 1826
  Description of Artificial Sequence: Synthetic construct

SEQ ID NO: 5365 - DNA, 1968 bp, Artificial Sequence; identical to SEQ ID NO: 1828
  Description of Artificial Sequence: Synthetic construct

SEQ ID NO: 5366 - DNA, 1956 bp, Artificial Sequence; identical to SEQ ID NO: 1830
  Description of Artificial Sequence: Synthetic construct

SEQ ID NO: 5367 - DNA, 1623 bp, Artificial Sequence; identical to SEQ ID NO: 172
  Description of Artificial Sequence: Synthetic construct

SEQ ID NO: 5368 - DNA, 2130 bp, Artificial Sequence; identical to SEQ ID NO: 1834
  Description of Artificial Sequence: Synthetic construct

SEQ ID NO: 5369 - DNA, 2214 bp, Artificial Sequence; identical to SEQ ID NO: 173
  Description of Artificial Sequence: Synthetic construct

SEQ ID NO: 5370 - DNA, 1980 bp, Artificial Sequence; identical to SEQ ID NO: 1838
  Description of Artificial Sequence: Synthetic construct

SEQ ID NO: 5371 - DNA, 1623 bp, Artificial Sequence; identical to SEQ ID NO: 172
  Description of Artificial Sequence: Synthetic construct

SEQ ID NO: 5372 - DNA, 1956 bp, Artificial Sequence; identical to SEQ ID NO: 1830
  Description of Artificial Sequence: Synthetic construct

SEQ ID NO: 5373 - DNA, 1959 bp, Artificial Sequence; identical to SEQ ID NO: 1822
  Description of Artificial Sequence: Synthetic construct

SEQ ID NO: 5374 - DNA, 603 bp, Artificial Sequence; identical to SEQ ID NO: 1795
  Description of Artificial Sequence: Synthetic promoter

SEQ ID NO: 5375 - DNA, 1339 bp, Artificial Sequence; identical to SEQ ID NO: 1796
  Description of Artificial Sequence: Synthetic promoter

SEQ ID NO: 5376 - DNA, 1335 bp, Artificial Sequence; identical to SEQ ID NO: 1798
  Description of Artificial Sequence: Synthetic promoter

SEQ ID NO: 5377 - DNA, 399 bp, Artificial Sequence; identical to SEQ ID NO: 1797
  Description of Artificial Sequence: Synthetic promoter

SEQ ID NO: 5378 - DNA, 603 bp, Artificial Sequence; identical to SEQ ID NO: 1795
  Description of Artificial Sequence: Synthetic promoter

SEQ ID NO: 5379 - DNA, 1339 bp, Artificial Sequence; identical to SEQ ID NO: 1796
  Description of Artificial Sequence: Synthetic promoter

SEQ ID NO: 5380 - DNA, 1335 bp, Artificial Sequence; identical to SEQ ID NO: 1798
  Description of Artificial Sequence: Synthetic promoter

SEQ ID NO: 5381 - DNA, 399 bp, Artificial Sequence; identical to SEQ ID NO: 1797
  Description of Artificial Sequence: Synthetic promoter

SEQ ID NO: 5382 - DNA, 60 bp, Homo sapiens; identical to SEQ ID NO: 1776

SEQ ID NO: 5383 - DNA, 60 bp, Artificial Sequence; identical to SEQ ID NO: 1777
  Description of Artificial Sequence: Synthetic signal sequence

SEQ ID NO: 5384 - DNA, 60 bp, Artificial Sequence; identical to SEQ ID NO: 1778
  Description of Artificial Sequence: Synthetic signal sequence

SEQ ID NO: 5385 - DNA, 60 bp, Artificial Sequence; identical to SEQ ID NO: 1779
  Description of Artificial Sequence: Synthetic signal sequence

SEQ ID NO: 5386 - DNA, 54 bp, Homo sapiens; identical to SEQ ID NO: 1850

SEQ ID NO: 5387 - DNA, 54 bp, Homo sapiens; identical to SEQ ID NO: 1851

SEQ ID NO: 5388 - DNA, 54 bp, Homo sapiens; identical to SEQ ID NO: 1852

SEQ ID NO: 5389 - DNA, 18 bp, Artificial Sequence
  Description of Artificial Sequence: Synthetic linker sequence
gagttcagcaccgagttt

SEQ ID NO: 5390 - DNA, 18 bp, Artificial Sequence
  Description of Artificial Sequence: Synthetic linker sequence
gagttctccaccgagttc

SEQ ID NO: 5391 - DNA, 15 bp, Artificial Sequence
  Description of Artificial Sequence: Synthetic linker sequence
ggaggcagcggagga

SEQ ID NO: 5392 - DNA, 15 bp, Artificial Sequence
  Description of Artificial Sequence: Synthetic linker sequence
ggaggctctggagga

SEQ ID NO: 5393 - DNA, 15 bp, Artificial Sequence
  Description of Artificial Sequence: Synthetic linker sequence
ggaggctccggcgga

SEQ ID NO: 5394 - DNA, 15 bp, Artificial Sequence
  Description of Artificial Sequence: Synthetic linker sequence
ggaggatccggaggc

SEQ ID NO: 5395 - DNA, 15 bp, Artificial Sequence
  Description of Artificial Sequence: Synthetic linker sequence
ggaggatctggagga

SEQ ID NO: 5396 - DNA, 27 bp, Artificial Sequence
  Description of Artificial Sequence: Synthetic HA tag
tacccatacgatgttccagattacgct

SEQ ID NO: 5397 - DNA, 27 bp, Artificial Sequence
  Description of Artificial Sequence: Synthetic HA tag
tatccttacgatgtgcccgactatgct

SEQ ID NO: 5398 - DNA, 27 bp, Artificial Sequence
  Description of Artificial Sequence: Synthetic HA tag
tatccgtacgacgtaccagactacgca

SEQ ID NO: 5399 - DNA, 60 bp, Artificial Sequence; identical to SEQ ID NO: 1806
  Description of Artificial Sequence: Synthetic cleavable peptide

SEQ ID NO: 5400 - DNA, 705 bp, Artificial Sequence; identical to SEQ ID NO: 1626
  Description of Artificial Sequence: Synthetic polynucleotide

SEQ ID NO: 5401 - DNA, 345 bp, Homo sapiens; identical to SEQ ID NO: 168

SEQ ID NO: 5402 - DNA, 345 bp, Artificial Sequence; identical to SEQ ID NO: 1617
  Description of Artificial Sequence: Synthetic payload

SEQ ID NO: 5403 - DNA, 345 bp, Artificial Sequence; identical to SEQ ID NO: 1618
  Description of Artificial Sequence: Synthetic payload

SEQ ID NO: 5404 - DNA, 342 bp, Artificial Sequence; identical to SEQ ID NO: 1619
  Description of Artificial Sequence: Synthetic payload

SEQ ID NO: 5405 - DNA, 342 bp, Artificial Sequence; identical to SEQ ID NO: 1620
  Description of Artificial Sequence: Synthetic payload

SEQ ID NO: 5406 - DNA, 405 bp, Artificial Sequence; identical to SEQ ID NO: 1857
  Description of Artificial Sequence: Synthetic polynucleotide

SEQ ID NO: 5407 - DNA, 912 bp, Artificial Sequence; identical to SEQ ID NO: 1859
  Description of Artificial Sequence: Synthetic polynucleotide

SEQ ID NO: 5408 - DNA, 432 bp, Artificial Sequence; identical to SEQ ID NO: 1861
  Description of Artificial Sequence: Synthetic polynucleotide

SEQ ID NO: 5409 - DNA, 1170 bp, Artificial Sequence; identical to SEQ ID NO: 1863
  Description of Artificial Sequence: Synthetic polynucleotide

SEQ ID NO: 5410 - DNA, 1734 bp, Artificial Sequence; identical to SEQ ID NO: 1865
  Description of Artificial Sequence: Synthetic polynucleotide

SEQ ID NO: 5411 - DNA, 603 bp, Artificial Sequence; identical to SEQ ID NO: 1795
  Description of Artificial Sequence: Synthetic promoter

SEQ ID NO: 5412 - DNA, 1339 bp, Artificial Sequence; identical to SEQ ID NO: 1796
  Description of Artificial Sequence: Synthetic promoter

SEQ ID NO: 5413 - DNA, 1335 bp, Artificial Sequence; identical to SEQ ID NO: 1798
  Description of Artificial Sequence: Synthetic promoter

SEQ ID NO: 5414 - DNA, 399 bp, Artificial Sequence; identical to SEQ ID NO: 1797
  Description of Artificial Sequence: Synthetic promoter

SEQ ID NO: 5415 - DNA, 60 bp, Homo sapiens; identical to SEQ ID NO: 1776

SEQ ID NO: 5416 - DNA, 60 bp, Artificial Sequence; identical to SEQ ID NO: 1777
  Description of Artificial Sequence: Synthetic signal sequence

SEQ ID NO: 5417 - DNA, 60 bp, Artificial Sequence; identical to SEQ ID NO: 1778
  Description of Artificial Sequence: Synthetic signal sequence

SEQ ID NO: 5418 - DNA, 60 bp, Artificial Sequence; identical to SEQ ID NO: 1779
  Description of Artificial Sequence: Synthetic signal sequence

SEQ ID NO: 5419 - DNA, 54 bp, Homo sapiens; identical to SEQ ID NO: 1850

SEQ ID NO: 5420 - DNA, 54 bp, Artificial Sequence; identical to SEQ ID NO: 1851
  Description of Artificial Sequence: Synthetic signal sequence

SEQ ID NO: 5421 - DNA, 54 bp, Artificial Sequence; identical to SEQ ID NO: 1852
  Description of Artificial Sequence: Synthetic signal sequence

SEQ ID NO: 5422 - DNA, 18 bp, Artificial Sequence
  Description of Artificial Sequence: Synthetic linker sequence
gagttcagcaccgagttt

SEQ ID NO: 5423 - DNA, 18 bp, Artificial Sequence
  Description of Artificial Sequence: Synthetic linker sequence
gagttctccaccgagttc

SEQ ID NO: 5424 - DNA, 15 bp, Artificial Sequence
  Description of Artificial Sequence: Synthetic linker sequence
ggaggcagcggagga

SEQ ID NO: 5425 - DNA, 15 bp, Artificial Sequence
  Description of Artificial Sequence: Synthetic linker sequence
ggaggctctggagga

SEQ ID NO: 5426 - DNA, 15 bp, Artificial Sequence
  Description of Artificial Sequence: Synthetic linker sequence
ggaggctccggcgga

SEQ ID NO: 5427 - DNA, 15 bp, Artificial Sequence
  Description of Artificial Sequence: Synthetic linker sequence
ggaggatccggaggc

SEQ ID NO: 5428 - DNA, 15 bp, Artificial Sequence
  Description of Artificial Sequence: Synthetic linker sequence
ggaggatctggagga

SEQ ID NO: 5429 - DNA, 27 bp, Artificial Sequence
  Description of Artificial Sequence: Synthetic HA tag
tacccatacgatgttccagattacgct

SEQ ID NO: 5430 - DNA, 27 bp, Artificial Sequence
  Description of Artificial Sequence: Synthetic HA tag
tatccttacgatgtgcccgactatgct

SEQ ID NO: 5431 - DNA, 60 bp, Artificial Sequence; identical to SEQ ID NO: 1806
  Description of Artificial Sequence: Synthetic cleavable peptide

SEQ ID NO: 5432 - DNA, 708 bp, Artificial Sequence; identical to SEQ ID NO: 1896
  Description of Artificial Sequence: Synthetic polynucleotide

SEQ ID NO: 5433 - protein, 114 aa, Homo sapiens; identical to SEQ ID NO: 718

SEQ ID NO: 5434 - DNA, 345 bp, Homo sapiens; identical to SEQ ID NO: 168

SEQ ID NO: 5435 - DNA, 345 bp, Artificial Sequence; identical to SEQ ID NO: 1617
  Description of Artificial Sequence: Synthetic construct

SEQ ID NO: 5436 - DNA, 345 bp, Artificial Sequence; identical to SEQ ID NO: 1618
  Description of Artificial Sequence: Synthetic construct

SEQ ID NO: 5437 - DNA, 342 bp, Artificial Sequence; identical to SEQ ID NO: 1619
  Description of Artificial Sequence: Synthetic construct

SEQ ID NO: 5438 - DNA, 342 bp, Artificial Sequence; identical to SEQ ID NO: 1620
  Description of Artificial Sequence: Synthetic construct

SEQ ID NO: 5439 - DNA, 342 bp, Artificial Sequence; identical to SEQ ID NO: 1902
  Description of Artificial Sequence: Synthetic construct

SEQ ID NO: 5440 - DNA, 474 bp, Artificial Sequence; identical to SEQ ID NO: 1676
  Description of Artificial Sequence: Synthetic destabilizing domain (DD)

SEQ ID NO: 5441 - DNA, 474 bp, Artificial Sequence; identical to SEQ ID NO: 1678
  Description of Artificial Sequence: Synthetic destabilizing domain (DD)

SEQ ID NO: 5442 - DNA, 477 bp, Artificial Sequence; identical to SEQ ID NO: 1677
  Description of Artificial Sequence: Synthetic destabilizing domain (DD)

SEQ ID NO: 5443 - DNA, 558 bp, Artificial Sequence; identical to SEQ ID NO: 1685
  Description of Artificial Sequence: Synthetic destabilizing domain (DD)

SEQ ID NO: 5444 - DNA, 405 bp, Artificial Sequence; identical to SEQ ID NO: 1857
  Description of Artificial Sequence: Synthetic polynucleotide

SEQ ID NO: 5445 - DNA, 912 bp, Artificial Sequence; identical to SEQ ID NO: 1859
  Description of Artificial Sequence: Synthetic polynucleotide

SEQ ID NO: 5446 - DNA, 432 bp, Artificial Sequence; identical to SEQ ID NO: 1861
  Description of Artificial Sequence: Synthetic polynucleotide

SEQ ID NO: 5447 - DNA, 1170 bp, Artificial Sequence; identical to SEQ ID NO: 1863
  Description of Artificial Sequence: Synthetic polynucleotide

SEQ ID NO: 5448 - DNA, 1734 bp, Artificial Sequence; identical to SEQ ID NO: 1865
  Description of Artificial Sequence: Synthetic polynucleotide

SEQ ID NO: 5449 - protein, 61 aa, Homo sapiens; identical to SEQ ID NO: 723

SEQ ID NO: 5450 - protein, 237 aa, Homo sapiens; identical to SEQ ID NO: 724

SEQ ID NO: 5451 - protein, 175 aa, Homo sapiens; identical to SEQ ID NO: 725

SEQ ID NO: 5452 - DNA, 90 bp, Artificial Sequence; identical to SEQ ID NO: 1724
  Description of Artificial Sequence: Synthetic construct

SEQ ID NO: 5453 - DNA, 78 bp, Artificial Sequence; identical to SEQ ID NO: 1647
  Description of Artificial Sequence: Synthetic linker sequence

SEQ ID NO: 5454 - DNA, 78 bp, Artificial Sequence; identical to SEQ ID NO: 1648
  Description of Artificial Sequence: Synthetic linker sequence

SEQ ID NO: 5455 - DNA, 78 bp, Artificial Sequence; identical to SEQ ID NO: 1649
  Description of Artificial Sequence: Synthetic linker sequence

SEQ ID NO: 5456 - DNA, 78 bp, Artificial Sequence; identical to SEQ ID NO: 1650
  Description of Artificial Sequence: Synthetic linker sequence

SEQ ID NO: 5457 - DNA, 78 bp, Artificial Sequence; identical to SEQ ID NO: 1651
  Description of Artificial Sequence: Synthetic linker sequence

SEQ ID NO: 5458 - DNA, 78 bp, Artificial Sequence; identical to SEQ ID NO: 1652
  Description of Artificial Sequence: Synthetic linker sequence

SEQ ID NO: 5459 - DNA, 78 bp, Artificial Sequence; identical to SEQ ID NO: 1650
  Description of Artificial Sequence: Synthetic linker sequence

SEQ ID NO: 5460 - DNA, 15 bp, Artificial Sequence
  Description of Artificial Sequence: Synthetic linker sequence
tcaggtggcggtagt

SEQ ID NO: 5461 - DNA, 15 bp, Artificial Sequence
  Description of Artificial Sequence: Synthetic linker sequence
agcggcggtggcagc

SEQ ID NO: 5462 - DNA, 15 bp, Artificial Sequence
  Description of Artificial Sequence: Synthetic linker sequence
tcaggcggggggagt

SEQ ID NO: 5463 - DNA, 102 bp, Artificial Sequence; identical to SEQ ID NO: 1925
  Description of Artificial Sequence: Synthetic linker sequence

SEQ ID NO: 5464 - DNA, 60 bp, Artificial Sequence; identical to SEQ ID NO: 1927
  Description of Artificial Sequence: Synthetic linker sequence

SEQ ID NO: 5465 - DNA, 28 bp, Artificial Sequence
  Description of Artificial Sequence: Synthetic spacer
tctagataatacgactcactagagatcc

SEQ ID NO: 5466 - DNA, 16 bp, Artificial Sequence
  Description of Artificial Sequence: Synthetic spacer
tatggccacaaccatg

SEQ ID NO: 5467 - DNA, 30 bp, Artificial Sequence; identical to SEQ ID NO: 1934
  Description of Artificial Sequence: Synthetic spacer

SEQ ID NO: 5468 - DNA, 711 bp, Artificial Sequence; identical to SEQ ID NO: 1624
  Description of Artificial Sequence: Synthetic payload

SEQ ID NO: 5469 - DNA, 525 bp, Artificial Sequence; identical to SEQ ID NO: 1938
  Description of Artificial Sequence: Synthetic construct

SEQ ID NO: 5470 - DNA, 708 bp, Artificial Sequence; identical to SEQ ID NO: 1940
  Description of Artificial Sequence: Synthetic construct

SEQ ID NO: 5471 - DNA, 477 bp, Artificial Sequence; identical to SEQ ID NO: 1682
  Description of Artificial Sequence: Synthetic destabilizing domain (DD)

SEQ ID NO: 5472 - DNA, 474 bp, Artificial Sequence; identical to SEQ ID NO: 1683
  Description of Artificial Sequence: Synthetic destabilizing domain (DD)

SEQ ID NO: 5473 - DNA, 474 bp, Artificial Sequence; identical to SEQ ID NO: 1684
  Description of Artificial Sequence: Synthetic destabilizing domain (DD)

SEQ ID NO: 5474 - DNA, 561 bp, Artificial Sequence; identical to SEQ ID NO: 77
  Description of Artificial Sequence: Synthetic destabilizing domain (DD)

SEQ ID NO: 5475 - DNA, 561 bp, Artificial Sequence; identical to SEQ ID NO: 1688
  Description of Artificial Sequence: Synthetic destabilizing domain (DD)

SEQ ID NO: 5476 - DNA, 558 bp, Artificial Sequence; identical to SEQ ID NO: 1689
  Description of Artificial Sequence: Synthetic destabilizing domain (DD)

SEQ ID NO: 5477 - DNA, 558 bp, Artificial Sequence; identical to SEQ ID NO: 1690
  Description of Artificial Sequence: Synthetic destabilizing domain (DD)

SEQ ID NO: 5478 - DNA, 561 bp, Artificial Sequence; identical to SEQ ID NO: 85
  Description of Artificial Sequence: Synthetic destabilizing domain (DD)

SEQ ID NO: 5479 - DNA, 561 bp, Artificial Sequence; identical to SEQ ID NO: 1694
  Description of Artificial Sequence: Synthetic destabilizing domain (DD)

SEQ ID NO: 5480 - DNA, 558 bp, Artificial Sequence; identical to SEQ ID NO: 1695
  Description of Artificial Sequence: Synthetic destabilizing domain (DD)

SEQ ID NO: 5481 - DNA, 558 bp, Artificial Sequence; identical to SEQ ID NO: 1696
  Description of Artificial Sequence: Synthetic destabilizing domain (DD)

SEQ ID NO: 5482 - DNA, 558 bp, Artificial Sequence; identical to SEQ ID NO: 1943
  Description of Artificial Sequence: Synthetic destabilizing domain (DD)

SEQ ID NO: 5483 - DNA, 561 bp, Artificial Sequence; identical to SEQ ID NO: 1944
  Description of Artificial Sequence: Synthetic destabilizing domain (DD)

SEQ ID NO: 5484 - DNA, 561 bp, Artificial Sequence; identical to SEQ ID NO: 1944
  Description of Artificial Sequence: Synthetic destabilizing domain (DD)

SEQ ID NO: 5485 - DNA, 558 bp, Artificial Sequence; identical to SEQ ID NO: 1946
  Description of Artificial Sequence: Synthetic destabilizing domain (DD)

SEQ ID NO: 5486 - DNA, 558 bp, Artificial Sequence; identical to SEQ ID NO: 126
  Description of Artificial Sequence: Synthetic destabilizing domain (DD)

SEQ ID NO: 5487 - DNA, 558 bp, Artificial Sequence; identical to SEQ ID NO: 1948
  Description of Artificial Sequence: Synthetic destabilizing domain (DD)

SEQ ID NO: 5488 - DNA, 1668 bp, Artificial Sequence; identical to SEQ ID NO: 2107
  Description of Artificial Sequence: Synthetic polynucleotide

SEQ ID NO: 5489 - DNA, 1515 bp, Artificial Sequence; identical to SEQ ID NO: 1952
  Description of Artificial Sequence: Synthetic polynucleotide

SEQ ID NO: 5490 - DNA, 1188 bp, Artificial Sequence; identical to SEQ ID NO: 169
  Description of Artificial Sequence: Synthetic polynucleotide

SEQ ID NO: 5491 - DNA, 1668 bp, Artificial Sequence; identical to SEQ ID NO: 1956
  Description of Artificial Sequence: Synthetic polynucleotide

SEQ ID NO: 5492 - DNA, 1752 bp, Artificial Sequence; identical to SEQ ID NO: 170
  Description of Artificial Sequence: Synthetic polynucleotide

SEQ ID NO: 5493 - DNA, 1752 bp, Artificial Sequence; identical to SEQ ID NO: 171
  Description of Artificial Sequence: Synthetic polynucleotide

SEQ ID NO: 5494 - DNA, 1224 bp, Artificial Sequence; identical to SEQ ID NO: 1982
  Description of Artificial Sequence: Synthetic construct

SEQ ID NO: 5495 - DNA, 1752 bp, Artificial Sequence; identical to SEQ ID NO: 1964
  Description of Artificial Sequence: Synthetic construct

SEQ ID NO: 5496 - DNA, 1752 bp, Artificial Sequence; identical to SEQ ID NO: 1966
  Description of Artificial Sequence: Synthetic construct

SEQ ID NO: 5497 - DNA, 1215 bp, Artificial Sequence; identical to SEQ ID NO: 1968
  Description of Artificial Sequence: Synthetic construct

SEQ ID NO: 5498 - DNA, 1212 bp, Artificial Sequence; identical to SEQ ID NO: 1970
  Description of Artificial Sequence: Synthetic construct

SEQ ID NO: 5499 - DNA, 1212 bp, Artificial Sequence; identical to SEQ ID NO: 1972
  Description of Artificial Sequence: Synthetic construct

SEQ ID NO: 5500 - DNA, 1116 bp, Artificial Sequence; identical to SEQ ID NO: 1974
  Description of Artificial Sequence: Synthetic construct

SEQ ID NO: 5501 - DNA, 1224 bp, Artificial Sequence; identical to SEQ ID NO: 1976
  Description of Artificial Sequence: Synthetic construct

SEQ ID NO: 5502 - DNA, 1194 bp, Artificial Sequence; identical to SEQ ID NO: 1978
  Description of Artificial Sequence: Synthetic construct

SEQ ID NO: 5503 - DNA, 1668 bp, Artificial Sequence; identical to SEQ ID NO: 1980
  Description of Artificial Sequence: Synthetic construct

SEQ ID NO: 5504 - DNA, 1188 bp, Artificial Sequence; identical to SEQ ID NO: 169
  Description of Artificial Sequence: Synthetic polynucleotide

SEQ ID NO: 5505 - DNA, 1722 bp, Artificial Sequence; identical to SEQ ID NO: 1985
  Description of Artificial Sequence: Synthetic construct

SEQ ID NO: 5506 - DNA, 1245 bp, Artificial Sequence; identical to SEQ ID NO: 1987
  Description of Artificial Sequence: Synthetic construct

SEQ ID NO: 5507 - DNA, 1806 bp, Artificial Sequence; identical to SEQ ID NO: 1989
  Description of Artificial Sequence: Synthetic construct

SEQ ID NO: 5508 - DNA, 1806 bp, Artificial Sequence; identical to SEQ ID NO: 1991
  Description of Artificial Sequence: Synthetic construct

SEQ ID NO: 5509 - DNA, 1806 bp, Artificial Sequence; identical to SEQ ID NO: 1993
  Description of Artificial Sequence: Synthetic construct

SEQ ID NO: 5510 - DNA, 1806 bp, Artificial Sequence; identical to SEQ ID NO: 1995
  Description of Artificial Sequence: Synthetic construct

SEQ ID NO: 5511 - DNA, 1806 bp, Artificial Sequence; identical to SEQ ID NO: 1997
  Description of Artificial Sequence: Synthetic construct

SEQ ID NO: 5512 - DNA, 1806 bp, Artificial Sequence; identical to SEQ ID NO: 1999
  Description of Artificial Sequence: Synthetic construct

SEQ ID NO: 5513 - DNA, 2046 bp, Artificial Sequence; identical to SEQ ID NO: 2001
  Description of Artificial Sequence: Synthetic construct

SEQ ID NO: 5514 - DNA, 1959 bp, Artificial Sequence; identical to SEQ ID NO: 2003
  Description of Artificial Sequence: Synthetic construct

SEQ ID NO: 5515 - DNA, 2291 bp, Artificial Sequence; identical to SEQ ID NO: 2020
  Description of Artificial Sequence: Synthetic construct

SEQ ID NO: 5516 - DNA, 963 bp, Artificial Sequence; identical to SEQ ID NO: 2022
  Description of Artificial Sequence: Synthetic construct

SEQ ID NO: 5517 - DNA, 708 bp, Artificial Sequence; identical to SEQ ID NO: 1940
  Description of Artificial Sequence: Synthetic construct

SEQ ID NO: 5518 - DNA, 1735 bp, Artificial Sequence; identical to SEQ ID NO: 2035
  Description of Artificial Sequence: Synthetic construct

SEQ ID NO: 5519 - DNA, 405 bp, Artificial Sequence; identical to SEQ ID NO: 2037
  Description of Artificial Sequence: Synthetic construct

SEQ ID NO: 5520 - DNA, 708 bp, Artificial Sequence; identical to SEQ ID NO: 1940
  Description of Artificial Sequence: Synthetic construct

SEQ ID NO: 5521 - DNA, 90 bp, Artificial Sequence; identical to SEQ ID NO: 1724
  Description of Artificial Sequence: Synthetic signal sequence

SEQ ID NO: 5522 - DNA, 78 bp, Artificial Sequence; identical to SEQ ID NO: 1647
  Description of Artificial Sequence: Synthetic linker sequence

SEQ ID NO: 5523 - DNA, 78 bp, Artificial Sequence; identical to SEQ ID NO: 1649
  Description of Artificial Sequence: Synthetic linker

SEQ ID NO: 5524 - DNA, 78 bp, Artificial Sequence; identical to SEQ ID NO: 1650
  Description of Artificial Sequence: Synthetic linker

SEQ ID NO: 5525 - DNA, 78 bp, Artificial Sequence; identical to SEQ ID NO: 1651
  Description of Artificial Sequence: Synthetic linker

SEQ ID NO: 5526 - DNA, 78 bp, Artificial Sequence; identical to SEQ ID NO: 1652
  Description of Artificial Sequence: Synthetic linker

SEQ ID NO: 5527 - DNA, 15 bp, Artificial Sequence
  Description of Artificial Sequence: Synthetic linker
tcaggtggcggtagt

SEQ ID NO: 5528 - DNA, 15 bp, Artificial Sequence
  Description of Artificial Sequence: Synthetic linker
agcggcggtggcagc

SEQ ID NO: 5529 - DNA, 15 bp, Artificial Sequence
  Description of Artificial Sequence: Synthetic linker
tcaggcggggggagt

SEQ ID NO: 5530 - DNA, 102 bp, Artificial Sequence; identical to SEQ ID NO: 1925
  Description of Artificial Sequence: Synthetic linker

SEQ ID NO: 5531 - DNA, 60 bp, Artificial Sequence; identical to SEQ ID NO: 1927
  Description of Artificial Sequence: Synthetic linker

SEQ ID NO: 5532 - DNA, 28 bp, Artificial Sequence
  Description of Artificial Sequence: Synthetic spacer sequence
tctagataatacgactcactagagatcc

SEQ ID NO: 5533 - DNA, 16 bp, Artificial Sequence
  Description of Artificial Sequence: Synthetic spacer sequence
tatggccacaaccatg

SEQ ID NO: 5534 - DNA, 30 bp, Artificial Sequence; identical to SEQ ID NO: 1934
  Description of Artificial Sequence: Synthetic spacer sequence

SEQ ID NO: 5535 - DNA, 207 bp, Homo sapiens; identical to SEQ ID NO: 1549

SEQ ID NO: 5536 - DNA, 714 bp, Homo sapiens; identical to SEQ ID NO: 1622

SEQ ID NO: 5537 - DNA, 711 bp, Artificial Sequence; identical to SEQ ID NO: 1623
  Description of Artificial Sequence: Synthetic construct

SEQ ID NO: 5538 - DNA, 711 bp, Artificial Sequence; identical to SEQ ID NO: 2068
  Description of Artificial Sequence: Synthetic construct

SEQ ID NO: 5539 - DNA, 711 bp, Artificial Sequence; identical to SEQ ID NO: 1624
  Description of Artificial Sequence: Synthetic construct

SEQ ID NO: 5540 - DNA, 711 bp, Artificial Sequence; identical to SEQ ID NO: 2070
  Description of Artificial Sequence: Synthetic construct

SEQ ID NO: 5541 - DNA, 525 bp, Artificial Sequence; identical to SEQ ID NO: 1938
  Description of Artificial Sequence: Synthetic construct

SEQ ID NO: 5542 - DNA, 708 bp, Artificial Sequence; identical to SEQ ID NO: 1940
  Description of Artificial Sequence: Synthetic construct

SEQ ID NO: 5543 - DNA, 24 bp, Artificial Sequence
  Description of Artificial Sequence: Synthetic FLAG
gactacaaagacgatgacgacaag

SEQ ID NO: 5544 - DNA, 477 bp, Artificial Sequence; identical to SEQ ID NO: 1682
  Description of Artificial Sequence: Synthetic destabilizing domain (DD)

SEQ ID NO: 5545 - DNA, 474 bp, Artificial Sequence; identical to SEQ ID NO: 1683
  Description of Artificial Sequence: Synthetic destabilizing domain (DD)

SEQ ID NO: 5546 - DNA, 324 bp, Artificial Sequence; identical to SEQ ID NO: 1669
  Description of Artificial Sequence: Synthetic destabilizing domain (DD)

SEQ ID NO: 5547 - DNA, 324 bp, Artificial Sequence; identical to SEQ ID NO: 1670
  Description of Artificial Sequence: Synthetic destabilizing domain (DD)

SEQ ID NO: 5548 - DNA, 324 bp, Artificial Sequence; identical to SEQ ID NO: 1671
  Description of Artificial Sequence: Synthetic destabilizing domain (DD)

SEQ ID NO: 5549 - DNA, 324 bp, Artificial Sequence; identical to SEQ ID NO: 1672
  Description of Artificial Sequence: Synthetic destabilizing domain (DD)

SEQ ID NO: 5550 - DNA, 561 bp, Artificial Sequence; identical to SEQ ID NO: 77
  Description of Artificial Sequence: Synthetic destabilizing domain (DD)

SEQ ID NO: 5551 - DNA, 558 bp, Artificial Sequence; identical to SEQ ID NO: 1689
  Description of Artificial Sequence: Synthetic destabilizing domain (DD)

SEQ ID NO: 5552 - DNA, 561 bp, Artificial Sequence; identical to SEQ ID NO: 1688
  Description of Artificial Sequence: Synthetic destabilizing domain (DD)

SEQ ID NO: 5553 - DNA, 561 bp, Artificial Sequence; identical to SEQ ID NO: 85
  Description of Artificial Sequence: Synthetic destabilizing domain (DD)

SEQ ID NO: 5554 - DNA, 558 bp, Artificial Sequence; identical to SEQ ID NO: 1695
  Description of Artificial Sequence: Synthetic destabilizing domain (DD)

SEQ ID NO: 5555 - DNA, 561 bp, Artificial Sequence; identical to SEQ ID NO: 1694
  Description of Artificial Sequence: Synthetic destabilizing domain (DD)

SEQ ID NO: 5556 - DNA, 558 bp, Artificial Sequence; identical to SEQ ID NO: 1943
  Description of Artificial Sequence: Synthetic destabilizing domain (DD)

SEQ ID NO: 5557 - DNA, 561 bp, Artificial Sequence; identical to SEQ ID NO: 1944
  Description of Artificial Sequence: Synthetic destabilizing domain (DD)

SEQ ID NO: 5558 - DNA, 561 bp, Artificial Sequence; identical to SEQ ID NO: 1944
  Description of Artificial Sequence: Synthetic destabilizing domain (DD)

SEQ ID NO: 5559 - DNA, 558 bp, Artificial Sequence; identical to SEQ ID NO: 1946
  Description of Artificial Sequence: Synthetic destabilizing domain (DD)

SEQ ID NO: 5560 - DNA, 558 bp, Artificial Sequence; identical to SEQ ID NO: 1820
  Description of Artificial Sequence: Synthetic destabilizing domain (DD)

SEQ ID NO: 5561 - DNA, 558 bp, Artificial Sequence; identical to SEQ ID NO: 126
  Description of Artificial Sequence: Synthetic destabilizing domain (DD)

SEQ ID NO: 5562 - DNA, 558 bp, Artificial Sequence; identical to SEQ ID NO: 1948
  Description of Artificial Sequence: Synthetic destabilizing domain (DD)

SEQ ID NO: 5563 - DNA, 1668 bp, Artificial Sequence; identical to SEQ ID NO: 2107
  Description of Artificial Sequence: Synthetic polynucleotide

SEQ ID NO: 5564 - DNA, 1515 bp, Artificial Sequence; identical to SEQ ID NO: 1952
  Description of Artificial Sequence: Synthetic polynucleotide

SEQ ID NO: 5565 - DNA, 1188 bp, Artificial Sequence; identical to SEQ ID NO: 169
  Description of Artificial Sequence: Synthetic polynucleotide

SEQ ID NO: 5566 - DNA, 1668 bp, Artificial Sequence; identical to SEQ ID NO: 1956
  Description of Artificial Sequence: Synthetic polynucleotide

SEQ ID NO: 5567 - DNA, 1752 bp, Artificial Sequence; identical to SEQ ID NO: 170
  Description of Artificial Sequence: Synthetic polynucleotide

SEQ ID NO: 5568 - DNA, 1752 bp, Artificial Sequence; identical to SEQ ID NO: 171
  Description of Artificial Sequence: Synthetic polynucleotide

SEQ ID NO: 5569 - DNA, 1752 bp, Artificial Sequence; identical to SEQ ID NO: 1962
  Description of Artificial Sequence: Synthetic construct

SEQ ID NO: 5570 - DNA, 1752 bp, Artificial Sequence; identical to SEQ ID NO: 1964
  Description of Artificial Sequence: Synthetic polynucleotide

SEQ ID NO: 5571 - DNA, 1752 bp, Artificial Sequence; identical to SEQ ID NO: 1966
  Description of Artificial Sequence: Synthetic construct

SEQ ID NO: 5572 - DNA, 1215 bp, Artificial Sequence; identical to SEQ ID NO: 1968
  Description of Artificial Sequence: Synthetic construct

SEQ ID NO: 5573 - DNA, 1212 bp, Artificial Sequence; identical to SEQ ID NO: 1970
  Description of Artificial Sequence: Synthetic construct

SEQ ID NO: 5574 - DNA, 1212 bp, Artificial Sequence; identical to SEQ ID NO: 1972
  Description of Artificial Sequence: Synthetic construct

SEQ ID NO: 5575 - DNA, 1116 bp, Artificial Sequence; identical to SEQ ID NO: 1974
  Description of Artificial Sequence: Synthetic construct

SEQ ID NO: 5576 - DNA, 1224 bp, Artificial Sequence; identical to SEQ ID NO: 1976
  Description of Artificial Sequence: Synthetic construct

SEQ ID NO: 5577 - DNA, 1194 bp, Artificial Sequence; identical to SEQ ID NO: 1978
  Description of Artificial Sequence: Synthetic construct

SEQ ID NO: 5578 - DNA, 1668 bp, Artificial Sequence; identical to SEQ ID NO: 1980
  Description of Artificial Sequence: Synthetic construct

SEQ ID NO: 5579 - DNA, 1224 bp, Artificial Sequence; identical to SEQ ID NO: 1976
  Description of Artificial Sequence: Synthetic construct

SEQ ID NO: 5580 - DNA, 1116 bp, Artificial Sequence; identical to SEQ ID NO: 2141
  Description of Artificial Sequence: Synthetic construct

SEQ ID NO: 5581 - DNA, 1224 bp, Artificial Sequence; identical to SEQ ID NO: 1982
  Description of Artificial Sequence: Synthetic construct

SEQ ID NO: 5582 - DNA, 1188 bp, Artificial Sequence
  Description of Artificial Sequence: Synthetic construct
atggactggacctggattctgtttctggtggccgctgccacaagagtgcacagcaattgggtcaacgtgatcagcgacctgaagaagatcgaggacctgatccagagcatgcacatcgacgccacactgtacaccgagtccgatgtgcaccctagctgcaaagtgaccgccatgaagtgctttctgctggaactgcaagtgatcagcctggaaagcggcgacgccagcatccacgataccgtggaaaatctgatcatcctggccaacaacagcctgagcagcaacggcaatgtgaccgagagcggctgcaaagagtgcgaggaactggaagagaagaacatcaaagagttcctccagagcttcgtccacatcgtgcagatgttcatcaacaccagctctggcggaggaagcggaggcggaggatctggtggtggtggatctggcggcggtggtagtggcggaggttctctgcaaatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagatcccgctctggttcaccagaggcctgctcctccatctacagtgacaacagctggcgtgacccctcagcctgagtctctgtctccatctggaaaagagcctgccgccagctctcccagctctaacaatactgctgccaccacagccgccatcgtgcctggatctcagctgatgcctagcaagagccctagcaccggcacaacagagatcagctctcacgagtctagccacggcaccccatctcagaccacagccaagaattgggagctgaccgcctctgcctctcatcagccacctggtgtttaccctcaaggccactctgataccaccgtggccatcagcacaagcacagtgctgctgtgtggactgtctgccgtgtctctgctggcctgctacctgaagtctagacagacacctcctctggccagcgtggaaatggaagccatggaagctctgcctgtgacatggggcaccagcagcagagatgaggacctcgagaattgcagccaccacctgtag

SEQ ID NO: 5583 - DNA, 1722 bp, Artificial Sequence; identical to SEQ ID NO: 1985
  Description of Artificial Sequence: Synthetic construct

SEQ ID NO: 5584 - DNA, 1245 bp, Artificial Sequence; identical to SEQ ID NO: 1987
  Description of Artificial Sequence: Synthetic construct

SEQ ID NO: 5585 - DNA, 1806 bp, Artificial Sequence; identical to SEQ ID NO: 1989
  Description of Artificial Sequence: Synthetic construct

SEQ ID NO: 5586 - DNA, 1806 bp, Artificial Sequence; identical to SEQ ID NO: 1991
  Description of Artificial Sequence: Synthetic construct

SEQ ID NO: 5587 - DNA, 1806 bp, Artificial Sequence; identical to SEQ ID NO: 1993
  Description of Artificial Sequence: Synthetic construct

SEQ ID NO: 5588 - DNA, 1806 bp, Artificial Sequence; identical to SEQ ID NO: 1995
  Description of Artificial Sequence: Synthetic construct

SEQ ID NO: 5589 - DNA, 1806 bp, Artificial Sequence; identical to SEQ ID NO: 1997
  Description of Artificial Sequence: Synthetic construct

SEQ ID NO: 5590 - DNA, 1806 bp, Artificial Sequence; identical to SEQ ID NO: 1999
  Description of Artificial Sequence: Synthetic construct

SEQ ID NO: 5591 - DNA, 2046 bp, Artificial Sequence; identical to SEQ ID NO: 2001
  Description of Artificial Sequence: Synthetic construct

SEQ ID NO: 5592 - DNA, 1959 bp, Artificial Sequence; identical to SEQ ID NO: 2003
  Description of Artificial Sequence: Synthetic construct

SEQ ID NO: 5593 - DNA, 2291 bp, Artificial Sequence; identical to SEQ ID NO: 2020
  Description of Artificial Sequence: Synthetic construct

SEQ ID NO: 5594 - DNA, 963 bp, Artificial Sequence; identical to SEQ ID NO: 2022
  Description of Artificial Sequence: Synthetic construct

SEQ ID NO: 5595 - DNA, 708 bp, Artificial Sequence; identical to SEQ ID NO: 1940
  Description of Artificial Sequence: Synthetic construct

SEQ ID NO: 5596 - DNA, 1735 bp, Artificial Sequence; identical to SEQ ID NO: 2035
  Description of Artificial Sequence: Synthetic construct

SEQ ID NO: 5597 - DNA, 405 bp, Artificial Sequence; identical to SEQ ID NO: 2037
  Description of Artificial Sequence: Synthetic construct

SEQ ID NO: 5598 - DNA, 60 bp, Homo sapiens; identical to SEQ ID NO: 1777

SEQ ID NO: 5599 - DNA, 60 bp, Artificial Sequence; identical to SEQ ID NO: 1776
  Description of Artificial Sequence: Synthetic signal sequence

SEQ ID NO: 5600 - DNA, 60 bp, Artificial Sequence; identical to SEQ ID NO: 1778
  Description of Artificial Sequence: Synthetic signal sequence

SEQ ID NO: 5601 - DNA, 60 bp, Artificial Sequence; identical to SEQ ID NO: 1779
  Description of Artificial Sequence: Synthetic signal sequence

SEQ ID NO: 5602 - DNA, 54 bp, Homo sapiens; identical to SEQ ID NO: 1850

SEQ ID NO: 5603 - DNA, 345 bp, Homo sapiens; identical to SEQ ID NO: 168

SEQ ID NO: 5604 - DNA, 342 bp, Artificial Sequence; identical to SEQ ID NO: 1619
  Description of Artificial Sequence: Synthetic construct

SEQ ID NO: 5605 - DNA, 345 bp, Artificial Sequence; identical to SEQ ID NO: 1617
  Description of Artificial Sequence: Synthetic construct

SEQ ID NO: 5606 - DNA, 345 bp, Artificial Sequence; identical to SEQ ID NO: 1618
  Description of Artificial Sequence: Synthetic construct

SEQ ID NO: 5607 - DNA, 78 bp, Artificial Sequence; identical to SEQ ID NO: 1647
  Description of Artificial Sequence: Synthetic linker

SEQ ID NO: 5608 - DNA, 561 bp, Artificial Sequence; identical to SEQ ID NO: 77
  Description of Artificial Sequence: Synthetic destabilizing domain (DD)

SEQ ID NO: 5609 - DNA, 561 bp, Artificial Sequence; identical to SEQ ID NO: 85
  Description of Artificial Sequence: Synthetic destabilizing domain (DD)

SEQ ID NO: 5610 - DNA, 1188 bp, Artificial Sequence; identical to SEQ ID NO: 169
  Description of Artificial Sequence: Synthetic polynucleotide

SEQ ID NO: 5611 - DNA, 1752 bp, Artificial Sequence; identical to SEQ ID NO: 170
  Description of Artificial Sequence: Synthetic polynucleotide

SEQ ID NO: 5612 - DNA, 1752 bp, Artificial Sequence; identical to SEQ ID NO: 171
  Description of Artificial Sequence: Synthetic polynucleotide

SEQ ID NO: 5613 - protein, 187 aa, Homo sapiens; identical to SEQ ID NO: 1

SEQ ID NO: 5614 - DNA, 66 bp, Homo sapiens; identical to SEQ ID NO: 1580

SEQ ID NO: 5615 - DNA, 66 bp, Artificial Sequence; identical to SEQ ID NO: 1581
  Description of Artificial Sequence: Synthetic signal sequence

SEQ ID NO: 5616 - DNA, 66 bp, Artificial Sequence; identical to SEQ ID NO: 1582
  Description of Artificial Sequence: Synthetic signal sequence

SEQ ID NO: 5617 - DNA, 66 bp, Artificial Sequence; identical to SEQ ID NO: 1583
  Description of Artificial Sequence: Synthetic signal sequence

SEQ ID NO: 5618 - DNA, 66 bp, Artificial Sequence; identical to SEQ ID NO: 1584
  Description of Artificial Sequence: Synthetic signal sequence

SEQ ID NO: 5619 - DNA, 66 bp, Artificial Sequence; identical to SEQ ID NO: 1585
  Description of Artificial Sequence: Synthetic signal sequence

SEQ ID NO: 5620 - DNA, 66 bp, Artificial Sequence; identical to SEQ ID NO: 1586
  Description of Artificial Sequence: Synthetic signal sequence

SEQ ID NO: 5621 - DNA, 66 bp, Artificial Sequence; identical to SEQ ID NO: 1587
  Description of Artificial Sequence: Synthetic signal sequence

SEQ ID NO: 5622 - DNA, 66 bp, Artificial Sequence; identical to SEQ ID NO: 1588
  Description of Artificial Sequence: Synthetic signal sequence

SEQ ID NO: 5623 - DNA, 45 bp, Artificial Sequence; identical to SEQ ID NO: 1636
  Description of Artificial Sequence: Synthetic linker

SEQ ID NO: 5624 - DNA, 45 bp, Artificial Sequence; identical to SEQ ID NO: 1637
  Description of Artificial Sequence: Synthetic linker

SEQ ID NO: 5625 - DNA, 45 bp, Artificial Sequence; identical to SEQ ID NO: 1638
  Description of Artificial Sequence: Synthetic linker

SEQ ID NO: 5626 - DNA, 45 bp, Artificial Sequence; identical to SEQ ID NO: 1639
  Description of Artificial Sequence: Synthetic linker

SEQ ID NO: 5627 - DNA, 45 bp, Artificial Sequence; identical to SEQ ID NO: 1640
  Description of Artificial Sequence: Synthetic linker

SEQ ID NO: 5628 - DNA, 45 bp, Artificial Sequence; identical to SEQ ID NO: 1641
  Description of Artificial Sequence: Synthetic linker

SEQ ID NO: 5629 - DNA, 36 bp, Artificial Sequence; identical to SEQ ID NO: 1337
  Description of Artificial Sequence: Synthetic cleavage site

SEQ ID NO: 5630 - DNA, 36 bp, Artificial Sequence; identical to SEQ ID NO: 1338
  Description of Artificial Sequence: Synthetic cleavage site

SEQ ID NO: 5631 - DNA, 36 bp, Artificial Sequence; identical to SEQ ID NO: 1339
  Description of Artificial Sequence: Synthetic cleavage site

SEQ ID NO: 5632 - DNA, 921 bp, Homo sapiens; identical to SEQ ID NO: 1593

SEQ ID NO: 5633 - DNA, 918 bp, Artificial Sequence; identical to SEQ ID NO: 1594
  Description of Artificial Sequence: Synthetic construct

SEQ ID NO: 5634 - DNA, 918 bp, Artificial Sequence; identical to SEQ ID NO: 1595
  Description of Artificial Sequence: Synthetic construct

SEQ ID NO: 5635 - DNA, 918 bp, Artificial Sequence; identical to SEQ ID NO: 1596
  Description of Artificial Sequence: Synthetic construct

SEQ ID NO: 5636 - DNA, 918 bp, Artificial Sequence; identical to SEQ ID NO: 1597
  Description of Artificial Sequence: Synthetic construct

SEQ ID NO: 5637 - DNA, 918 bp, Artificial Sequence; identical to SEQ ID NO: 1590
  Description of Artificial Sequence: Synthetic construct

SEQ ID NO: 5638 - DNA, 918 bp, Artificial Sequence; identical to SEQ ID NO: 1591
  Description of Artificial Sequence: Synthetic construct

SEQ ID NO: 5639 - DNA, 918 bp, Artificial Sequence; identical to SEQ ID NO: 1600
  Description of Artificial Sequence: Synthetic construct

SEQ ID NO: 5640 - DNA, 918 bp, Artificial Sequence; identical to SEQ ID NO: 1601
  Description of Artificial Sequence: Synthetic construct

SEQ ID NO: 5641 - DNA, 918 bp, Artificial Sequence; identical to SEQ ID NO: 1602
  Description of Artificial Sequence: Synthetic construct

SEQ ID NO: 5642 - DNA, 591 bp, Artificial Sequence; identical to SEQ ID NO: 1613
  Description of Artificial Sequence: Synthetic construct

SEQ ID NO: 5643 - DNA, 582 bp, Homo sapiens; identical to SEQ ID NO: 2257

SEQ ID NO: 5644 - DNA, 558 bp, Artificial Sequence; identical to SEQ ID NO: 86
  Description of Artificial Sequence: Synthetic destabilizing domain (DD)

SEQ ID NO: 5645 - DNA, 1623 bp, Artificial Sequence; identical to SEQ ID NO: 172
  Description of Artificial Sequence: Synthetic polynucleotide

SEQ ID NO: 5646 - DNA, 2214 bp, Artificial Sequence; identical to SEQ ID NO: 173
  Description of Artificial Sequence: Synthetic polynucleotide

SEQ ID NO: 5647 - DNA, 1251 bp, Homo sapiens; identical to SEQ ID NO: 2261

SEQ ID NO: 5648 - DNA, 1248 bp, Homo sapiens; identical to SEQ ID NO: 2263

SEQ ID NO: 5649 - DNA, 15 bp, Artificial Sequence
  Description of Artificial Sequence: Synthetic linker
tcaggtggcggtagt

SEQ ID NO: 5650 - DNA, 561 bp, Artificial Sequence; identical to SEQ ID NO: 73
  Description of Artificial Sequence: Synthetic destabilizing domain (DD)

SEQ ID NO: 5651 - DNA, 561 bp, Artificial Sequence; identical to SEQ ID NO: 75
  Description of Artificial Sequence: Synthetic destabilizing domain (DD)

SEQ ID NO: 5652 - DNA, 561 bp, Artificial Sequence; identical to SEQ ID NO: 79
  Description of Artificial Sequence: Synthetic destabilizing domain (DD)

SEQ ID NO: 5653 - DNA, 1824 bp, Artificial Sequence; identical to SEQ ID NO: 178
  Description of Artificial Sequence: Synthetic polynucleotide

SEQ ID NO: 5654 - DNA, 1824 bp, Artificial Sequence; identical to SEQ ID NO: 179
  Description of Artificial Sequence: Synthetic polynucleotide

SEQ ID NO: 5655 - DNA, 1824 bp, Artificial Sequence; identical to SEQ ID NO: 180
  Description of Artificial Sequence: Synthetic polynucleotide

SEQ ID NO: 5656 - DNA, 60 bp, Homo sapiens; identical to SEQ ID NO: 1777

SEQ ID NO: 5657 - DNA, 60 bp, Artificial Sequence; identical to SEQ ID NO: 1776
  Description of Artificial Sequence: Synthetic signal sequence

SEQ ID NO: 5658 - DNA, 60 bp, Artificial Sequence; identical to SEQ ID NO: 1778
  Description of Artificial Sequence: Synthetic signal sequence

SEQ ID NO: 5659 - DNA, 60 bp, Artificial Sequence; identical to SEQ ID NO: 1779
  Description of Artificial Sequence: Synthetic signal sequence

SEQ ID NO: 5660 - DNA, 1245 bp, Homo sapiens; identical to SEQ ID NO: 2269

SEQ ID NO: 5661 - DNA, 1245 bp, Homo sapiens; identical to SEQ ID NO: 2270

SEQ ID NO: 5662 - DNA, 855 bp, Homo sapiens; identical to SEQ ID NO: 2272

SEQ ID NO: 5663 - DNA, 39 bp, Artificial Sequence; identical to SEQ ID NO: 2274
  Description of Artificial Sequence: Synthetic linker

SEQ ID NO: 5664 - DNA, 15 bp, Artificial Sequence
  Description of Artificial Sequence: Synthetic linker
tcaggtggcggtagt

SEQ ID NO: 5665 - DNA, 15 bp, Artificial Sequence
  Description of Artificial Sequence: Synthetic linker
agcggcggtggcagc

SEQ ID NO: 5666 - DNA, 15 bp, Artificial Sequence
  Description of Artificial Sequence: Synthetic linker
tcaggcggggggagt

SEQ ID NO: 5667 - DNA, 39 bp, Artificial Sequence; identical to SEQ ID NO: 2280
  Description of Artificial Sequence: Synthetic linker

SEQ ID NO: 5668 - DNA, 321 bp, Artificial Sequence; identical to SEQ ID NO: 1786
  Description of Artificial Sequence: Synthetic Destabilized Domian (DD)

SEQ ID NO: 5669 - DNA, 321 bp, Artificial Sequence; identical to SEQ ID NO: 1664
  Description of Artificial Sequence: Synthetic Destabilized Domian (DD)

SEQ ID NO: 5670 - DNA, 321 bp, Artificial Sequence; identical to SEQ ID NO: 1665
  Description of Artificial Sequence: Synthetic Destabilized Domian (DD)

SEQ ID NO: 5671 - DNA, 321 bp, Artificial Sequence; identical to SEQ ID NO: 1666
  Description of Artificial Sequence: Synthetic Destabilized Domian (DD)

SEQ ID NO: 5672 - DNA, 321 bp, Artificial Sequence; identical to SEQ ID NO: 1667
  Description of Artificial Sequence: Synthetic Destabilized Domian (DD)

SEQ ID NO: 5673 - DNA, 321 bp, Artificial Sequence; identical to SEQ ID NO: 1668
  Description of Artificial Sequence: Synthetic Destabilized Domian (DD)

SEQ ID NO: 5674 - DNA, 321 bp, Artificial Sequence; identical to SEQ ID NO: 2283
  Description of Artificial Sequence: Synthetic Destabilized Domian (DD)

SEQ ID NO: 5675 - DNA, 321 bp, Artificial Sequence; identical to SEQ ID NO: 1764
  Description of Artificial Sequence: Synthetic Destabilized Domian (DD)

SEQ ID NO: 5676 - DNA, 324 bp, Artificial Sequence; identical to SEQ ID NO: 1669
  Description of Artificial Sequence: Synthetic Destabilized Domian (DD)

SEQ ID NO: 5677 - DNA, 324 bp, Artificial Sequence; identical to SEQ ID NO: 1670
  Description of Artificial Sequence: Synthetic Destabilized Domian (DD)

SEQ ID NO: 5678 - DNA, 324 bp, Artificial Sequence; identical to SEQ ID NO: 1671
  Description of Artificial Sequence: Synthetic Destabilized Domian (DD)

SEQ ID NO: 5679 - DNA, 324 bp, Artificial Sequence; identical to SEQ ID NO: 1672
  Description of Artificial Sequence: Synthetic Destabilized Domian (DD)

SEQ ID NO: 5680 - DNA, 321 bp, Artificial Sequence; identical to SEQ ID NO: 1673
  Description of Artificial Sequence: Synthetic Destabilized Domian (DD)

SEQ ID NO: 5681 - DNA, 321 bp, Artificial Sequence; identical to SEQ ID NO: 1674
  Description of Artificial Sequence: Synthetic Destabilized Domian (DD)

SEQ ID NO: 5682 - DNA, 321 bp, Artificial Sequence; identical to SEQ ID NO: 1675
  Description of Artificial Sequence: Synthetic Destabilized Domian (DD)

SEQ ID NO: 5683 - DNA, 477 bp, Artificial Sequence
  Description of Artificial Sequence: Synthetic Destabilized Domian (DD)
atgatctctctgattgcggcgctggcagttgactacgttattggcatggaaaacgcgatgccatggaacctcccggctgacctggcgtggttcaaacgtaacaccctgaacaaacctgtgatcatgggtcgtcacacctgggaatctattggccgtcctctcccgggtcgtaaaaacatcattctgtcttctcagccaggcaccgacgaccgtgttacctgggttaaaagcgttgacgaagcgattgctgcgtgcggtgatgttcctgaaattatggtgatcggcggtggccgtgttatcgaacagttcctgccgaaagcgcagaaactgtacctgacccacatcgacgcggaagttgaaggtgacacccacttcccggactacgaaccggatgattgggagagcgtattctccgaattccatgatgcggatgcgcaaaactctcattcttactgttttgaaatcctggaacgtcgt

SEQ ID NO: 5684 - DNA, 236 bp, Artificial Sequence; identical to SEQ ID NO: 2287
  Description of Artificial Sequence: Synthetic Destabilized Domian (DD)

SEQ ID NO: 5685 - DNA, 474 bp, Artificial Sequence; identical to SEQ ID NO: 1678
  Description of Artificial Sequence: Synthetic Destabilized Domian (DD)

SEQ ID NO: 5686 - DNA, 474 bp, Artificial Sequence; identical to SEQ ID NO: 1676
  Description of Artificial Sequence: Synthetic Destabilized Domian (DD)

SEQ ID NO: 5687 - DNA, 477 bp, Artificial Sequence; identical to SEQ ID NO: 1677
  Description of Artificial Sequence: Synthetic Destabilized Domian (DD)

SEQ ID NO: 5688 - DNA, 474 bp, Artificial Sequence; identical to SEQ ID NO: 1678
  Description of Artificial Sequence: Synthetic Destabilized Domian (DD)

SEQ ID NO: 5689 - DNA, 474 bp, Artificial Sequence; identical to SEQ ID NO: 1679
  Description of Artificial Sequence: Synthetic Destabilized Domian (DD)

SEQ ID NO: 5690 - DNA, 474 bp, Artificial Sequence; identical to SEQ ID NO: 1680
  Description of Artificial Sequence: Synthetic Destabilized Domian (DD)

SEQ ID NO: 5691 - DNA, 474 bp, Artificial Sequence; identical to SEQ ID NO: 1681
  Description of Artificial Sequence: Synthetic Destabilized Domian (DD)

SEQ ID NO: 5692 - DNA, 561 bp, Artificial Sequence; identical to SEQ ID NO: 73
  Description of Artificial Sequence: Synthetic Destabilized Domian (DD)

SEQ ID NO: 5693 - DNA, 561 bp, Artificial Sequence; identical to SEQ ID NO: 75
  Description of Artificial Sequence: Synthetic Destabilized Domian (DD)

SEQ ID NO: 5694 - DNA, 561 bp, Artificial Sequence; identical to SEQ ID NO: 79
  Description of Artificial Sequence: Synthetic Destabilized Domian (DD)

SEQ ID NO: 5695 - DNA, 1587 bp, Artificial Sequence; identical to SEQ ID NO: 2294
  Description of Artificial Sequence: Synthetic Payload sequence

SEQ ID NO: 5696 - DNA, 1740 bp, Artificial Sequence; identical to SEQ ID NO: 2295
  Description of Artificial Sequence: Synthetic Payload sequence

SEQ ID NO: 5697 - DNA, 1824 bp, Artificial Sequence; identical to SEQ ID NO: 178
  Description of Artificial Sequence: Synthetic Payload sequence

SEQ ID NO: 5698 - DNA, 1824 bp, Artificial Sequence; identical to SEQ ID NO: 179
  Description of Artificial Sequence: Synthetic Payload sequence

SEQ ID NO: 5699 - DNA, 1824 bp, Artificial Sequence; identical to SEQ ID NO: 180
  Description of Artificial Sequence: Synthetic Payload sequence

SEQ ID NO: 5700 - DNA, 1242 bp, Artificial Sequence; identical to SEQ ID NO: 2299
  Description of Artificial Sequence: Synthetic Payload sequence

SEQ ID NO: 5701 - DNA, 1578 bp, Artificial Sequence; identical to SEQ ID NO: 2300
  Description of Artificial Sequence: Synthetic Payload sequence

SEQ ID NO: 5702 - DNA, 1731 bp, Artificial Sequence; identical to SEQ ID NO: 2301
  Description of Artificial Sequence: Synthetic Payload sequence

SEQ ID NO: 5703 - DNA, 1731 bp, Artificial Sequence; identical to SEQ ID NO: 2302
  Description of Artificial Sequence: Synthetic Payload sequence

SEQ ID NO: 5704 - DNA, 15 bp, Artificial Sequence
  Description of Artificial Sequence: Synthetic Linker sequence
tcaggtggcggtagt

SEQ ID NO: 5705 - DNA, 15 bp, Artificial Sequence
  Description of Artificial Sequence: Synthetic Linker sequence
agcggcggtggcagc

SEQ ID NO: 5706 - DNA, 15 bp, Artificial Sequence
  Description of Artificial Sequence: Synthetic Linker sequence
tcaggcggggggagt

SEQ ID NO: 5707 - DNA, 321 bp, Artificial Sequence; identical to SEQ ID NO: 1786
  Description of Artificial Sequence: Synthetic Destabilized Domain (DD)

SEQ ID NO: 5708 - DNA, 321 bp, Artificial Sequence; identical to SEQ ID NO: 1664
  Description of Artificial Sequence: Synthetic Destabilizing Domain (DD)

SEQ ID NO: 5709 - DNA, 321 bp, Artificial Sequence; identical to SEQ ID NO: 1665
  Description of Artificial Sequence: Synthetic Destabilizing Domain (DD)

SEQ ID NO: 5710 - DNA, 321 bp, Artificial Sequence; identical to SEQ ID NO: 1666
  Description of Artificial Sequence: Synthetic Destabilizing Domain (DD)

SEQ ID NO: 5711 - DNA, 321 bp, Artificial Sequence; identical to SEQ ID NO: 1667
  Description of Artificial Sequence: Synthetic Destabilizing Domain (DD)

SEQ ID NO: 5712 - DNA, 321 bp, Artificial Sequence; identical to SEQ ID NO: 1668
  Description of Artificial Sequence: Synthetic Destabilizing Domain (DD)

SEQ ID NO: 5713 - DNA, 321 bp, Artificial Sequence; identical to SEQ ID NO: 1764
  Description of Artificial Sequence: Synthetic Destabilizing Domain (DD)

SEQ ID NO: 5714 - DNA, 324 bp, Artificial Sequence; identical to SEQ ID NO: 1669
  Description of Artificial Sequence: Synthetic Destabilizing Domain (DD)

SEQ ID NO: 5715 - DNA, 324 bp, Artificial Sequence; identical to SEQ ID NO: 1670
  Description of Artificial Sequence: Synthetic Destabilizing Domain (DD)

SEQ ID NO: 5716 - DNA, 324 bp, Artificial Sequence; identical to SEQ ID NO: 1671
  Description of Artificial Sequence: Synthetic Destabilizing Domain (DD)

SEQ ID NO: 5717 - DNA, 324 bp, Artificial Sequence; identical to SEQ ID NO: 1672
  Description of Artificial Sequence: Synthetic Destabilizing Domain (DD)

SEQ ID NO: 5718 - DNA, 321 bp, Artificial Sequence; identical to SEQ ID NO: 1673
  Description of Artificial Sequence: Synthetic Destabilizing Domain (DD)

SEQ ID NO: 5719 - DNA, 321 bp, Artificial Sequence; identical to SEQ ID NO: 1674
  Description of Artificial Sequence: Synthetic Destabilizing Domain (DD)

SEQ ID NO: 5720 - DNA, 321 bp, Artificial Sequence; identical to SEQ ID NO: 1675
  Description of Artificial Sequence: Synthetic Destabilizing Domain (DD)

SEQ ID NO: 5721 - DNA, 477 bp, Artificial Sequence; identical to SEQ ID NO: 5683
  Description of Artificial Sequence: Synthetic Destabilizing Domain (DD)

SEQ ID NO: 5722 - DNA, 474 bp, Artificial Sequence; identical to SEQ ID NO: 1678
  Description of Artificial Sequence: Synthetic Destabilized Domain (DD)

SEQ ID NO: 5723 - DNA, 474 bp, Artificial Sequence; identical to SEQ ID NO: 1676
  Description of Artificial Sequence: Synthetic Destabilizing Domain (DD)

SEQ ID NO: 5724 - DNA, 474 bp, Artificial Sequence; identical to SEQ ID NO: 1681
  Description of Artificial Sequence: Synthetic Destabilizing Domain (DD)

SEQ ID NO: 5725 - DNA, 1293 bp, Artificial Sequence; identical to SEQ ID NO: 2303
  Description of Artificial Sequence: Synthetic Payload sequence

SEQ ID NO: 5726 - DNA, 1290 bp, Artificial Sequence; identical to SEQ ID NO: 2304
  Description of Artificial Sequence: Synthetic Payload sequence

SEQ ID NO: 5727 - DNA, 1188 bp, Artificial Sequence; identical to SEQ ID NO: 2305
  Description of Artificial Sequence: Synthetic Payload sequence

SEQ ID NO: 5728 - DNA, 1185 bp, Artificial Sequence; identical to SEQ ID NO: 2306
  Description of Artificial Sequence: Synthetic Payload sequence

SEQ ID NO: 5729 - DNA, 1296 bp, Artificial Sequence; identical to SEQ ID NO: 2307
  Description of Artificial Sequence: Synthetic construct

SEQ ID NO: 5730 - DNA, 1191 bp, Artificial Sequence; identical to SEQ ID NO: 2308
  Description of Artificial Sequence: Synthetic construct

SEQ ID NO: 5731 - DNA, 1632 bp, Artificial Sequence; identical to SEQ ID NO: 2309
  Description of Artificial Sequence: Synthetic construct

SEQ ID NO: 5732 - DNA, 1785 bp, Artificial Sequence; identical to SEQ ID NO: 2310
  Description of Artificial Sequence: Synthetic construct

SEQ ID NO: 5733 - DNA, 1623 bp, Artificial Sequence; identical to SEQ ID NO: 2311
  Description of Artificial Sequence: Synthetic construct

SEQ ID NO: 5734 - DNA, 1776 bp, Artificial Sequence; identical to SEQ ID NO: 2312
  Description of Artificial Sequence: Synthetic construct

SEQ ID NO: 5735 - DNA, 1518 bp, Artificial Sequence; identical to SEQ ID NO: 2313
  Description of Artificial Sequence: Synthetic construct

SEQ ID NO: 5736 - DNA, 1671 bp, Artificial Sequence; identical to SEQ ID NO: 2314
  Description of Artificial Sequence: Synthetic construct

SEQ ID NO: 5737 - DNA, 1518 bp, Artificial Sequence; identical to SEQ ID NO: 2315
  Description of Artificial Sequence: Synthetic construct

SEQ ID NO: 5738 - DNA, 1671 bp, Artificial Sequence; identical to SEQ ID NO: 2316
  Description of Artificial Sequence: Synthetic construct

SEQ ID NO: 5739 - DNA, 60 bp, Homo sapiens; identical to SEQ ID NO: 1777

SEQ ID NO: 5740 - DNA, 60 bp, Artificial Sequence; identical to SEQ ID NO: 1776
  Description of Artificial Sequence: Synthetic signal sequence

SEQ ID NO: 5741 - DNA, 60 bp, Artificial Sequence; identical to SEQ ID NO: 1778
  Description of Artificial Sequence: Synthetic signal sequence

SEQ ID NO: 5742 - DNA, 60 bp, Artificial Sequence; identical to SEQ ID NO: 1779
  Description of Artificial Sequence: Synthetic signal sequence

SEQ ID NO: 5743 - protein, 15 aa, Artificial Sequence
  Description of Artificial Sequence: Synthetic linker
GGGGSGGGGSGGGGS

SEQ ID NO: 5744 - protein, 12 aa, Artificial Sequence
  Description of Artificial Sequence: Synthetic cleavage site
ESRRVRRNKRSK

SEQ ID NO: 5745 - protein, 306 aa, Homo sapiens; identical to SEQ ID NO: 734

SEQ ID NO: 5746 - protein, 197 aa, Homo sapiens; identical to SEQ ID NO: 735

SEQ ID NO: 5747 - protein, 540 aa, Artificial Sequence; identical to SEQ ID NO: 1831
  Description of Artificial Sequence: Synthetic polypeptide

SEQ ID NO: 5748 - protein, 738 aa, Artificial Sequence; identical to SEQ ID NO: 1835
  Description of Artificial Sequence: Synthetic polypeptide

SEQ ID NO: 5749 - DNA, 66 bp, Homo sapiens; identical to SEQ ID NO: 1580

SEQ ID NO: 5750 - DNA, 66 bp, Artificial Sequence; identical to SEQ ID NO: 1581
  Description of Artificial Sequence: Synthetic signal sequence

SEQ ID NO: 5751 - DNA, 66 bp, Artificial Sequence; identical to SEQ ID NO: 1582
  Description of Artificial Sequence: Synthetic signal sequence

SEQ ID NO: 5752 - DNA, 66 bp, Artificial Sequence; identical to SEQ ID NO: 1583
  Description of Artificial Sequence: Synthetic signal sequence

SEQ ID NO: 5753 - DNA, 66 bp, Artificial Sequence; identical to SEQ ID NO: 1584
  Description of Artificial Sequence: Synthetic signal sequence

SEQ ID NO: 5754 - DNA, 66 bp, Artificial Sequence; identical to SEQ ID NO: 1585
  Description of Artificial Sequence: Synthetic signal sequence

SEQ ID NO: 5755 - DNA, 66 bp, Artificial Sequence; identical to SEQ ID NO: 1586
  Description of Artificial Sequence: Synthetic signal sequence

SEQ ID NO: 5756 - DNA, 66 bp, Artificial Sequence; identical to SEQ ID NO: 1587
  Description of Artificial Sequence: Synthetic signal sequence

SEQ ID NO: 5757 - DNA, 66 bp, Artificial Sequence; identical to SEQ ID NO: 1588
  Description of Artificial Sequence: Synthetic signal sequence

SEQ ID NO: 5758 - protein, 21 aa, Artificial Sequence
  Description of Artificial Sequence: Synthetic peptide
LLLVTSLLLCELPHPAFLLIP

SEQ ID NO: 5759 - protein, 22 aa, Artificial Sequence
  Description of Artificial Sequence: Synthetic peptide
LLVTSLLLCELPHPAFLLIPDT

SEQ ID NO: 5760 - protein, 24 aa, Artificial Sequence
  Description of Artificial Sequence: Synthetic peptide
MVLLVTSLLLCELPHPAFLLIPDT

SEQ ID NO: 5761 - DNA, 60 bp, Homo sapiens; identical to SEQ ID NO: 1776

SEQ ID NO: 5762 - DNA, 60 bp, Artificial Sequence; identical to SEQ ID NO: 1777
  Description of Artificial Sequence: Synthetic signal sequence

SEQ ID NO: 5763 - DNA, 60 bp, Artificial Sequence; identical to SEQ ID NO: 1778
  Description of Artificial Sequence: Synthetic signal sequence

SEQ ID NO: 5764 - DNA, 60 bp, Artificial Sequence; identical to SEQ ID NO: 1779
  Description of Artificial Sequence: Synthetic signal sequence

SEQ ID NO: 5765 - protein, 22 aa, Homo sapiens
MCHQQLVISWFSLVFLASPLVA

SEQ ID NO: 5766 - DNA, 66 bp, Homo sapiens; identical to SEQ ID NO: 1580

SEQ ID NO: 5767 - DNA, 66 bp, Artificial Sequence; identical to SEQ ID NO: 1581
  Description of Artificial Sequence: Synthetic signal sequence

SEQ ID NO: 5768 - DNA, 66 bp, Artificial Sequence; identical to SEQ ID NO: 1582
  Description of Artificial Sequence: Synthetic signal sequence

SEQ ID NO: 5769 - DNA, 66 bp, Artificial Sequence; identical to SEQ ID NO: 1583
  Description of Artificial Sequence: Synthetic signal sequence

SEQ ID NO: 5770 - DNA, 66 bp, Artificial Sequence; identical to SEQ ID NO: 1584
  Description of Artificial Sequence: Synthetic signal sequence

SEQ ID NO: 5771 - DNA, 66 bp, Artificial Sequence; identical to SEQ ID NO: 1585
  Description of Artificial Sequence: Synthetic signal sequence

SEQ ID NO: 5772 - DNA, 66 bp, Artificial Sequence; identical to SEQ ID NO: 1586
  Description of Artificial Sequence: Synthetic signal sequence

SEQ ID NO: 5773 - DNA, 66 bp, Artificial Sequence; identical to SEQ ID NO: 1587
  Description of Artificial Sequence: Synthetic signal sequence

SEQ ID NO: 5774 - DNA, 66 bp, Artificial Sequence; identical to SEQ ID NO: 1588
  Description of Artificial Sequence: Synthetic signal sequence

SEQ ID NO: 5775 - DNA, 60 bp, Artificial Sequence; identical to SEQ ID NO: 1776
  Description of Artificial Sequence: Synthetic signal sequence

SEQ ID NO: 5776 - DNA, 60 bp, Homo sapiens; identical to SEQ ID NO: 1777

SEQ ID NO: 5777 - DNA, 60 bp, Artificial Sequence; identical to SEQ ID NO: 1778
  Description of Artificial Sequence: Synthetic signal sequence

SEQ ID NO: 5778 - DNA, 60 bp, Artificial Sequence; identical to SEQ ID NO: 1779
  Description of Artificial Sequence: Synthetic signal sequence

SEQ ID NO: 5779 - protein, 22 aa, Homo sapiens
MCHQQLVISWFSLVFLASPLVA

SEQ ID NO: 5780 - DNA, 66 bp, Homo sapiens; identical to SEQ ID NO: 1580

SEQ ID NO: 5781 - DNA, 66 bp, Artificial Sequence; identical to SEQ ID NO: 1581
  Description of Artificial Sequence: Synthetic signal sequence

SEQ ID NO: 5782 - DNA, 66 bp, Artificial Sequence; identical to SEQ ID NO: 1582
  Description of Artificial Sequence: Synthetic signal sequence

SEQ ID NO: 5783 - DNA, 66 bp, Artificial Sequence; identical to SEQ ID NO: 1583
  Description of Artificial Sequence: Synthetic signal sequence

SEQ ID NO: 5784 - DNA, 66 bp, Artificial Sequence; identical to SEQ ID NO: 1584
  Description of Artificial Sequence: Synthetic signal sequence

SEQ ID NO: 5785 - DNA, 66 bp, Artificial Sequence; identical to SEQ ID NO: 1585
  Description of Artificial Sequence: Synthetic signal sequence

SEQ ID NO: 5786 - DNA, 66 bp, Artificial Sequence; identical to SEQ ID NO: 1586
  Description of Artificial Sequence: Synthetic signal sequence

SEQ ID NO: 5787 - DNA, 66 bp, Artificial Sequence; identical to SEQ ID NO: 1587
  Description of Artificial Sequence: Synthetic signal sequence

SEQ ID NO: 5788 - DNA, 66 bp, Artificial Sequence; identical to SEQ ID NO: 1588
  Description of Artificial Sequence: Synthetic signal sequence

SEQ ID NO: 5789 - DNA, 90 bp, Artificial Sequence; identical to SEQ ID NO: 1724
  Description of Artificial Sequence: Synthetic leader sequence

SEQ ID NO: 5790 - protein, 22 aa, Artificial Sequence
  Description of Artificial Sequence: Synthetic signal sequence
LLVTSLLLCELPHPAFLLIPDT

SEQ ID NO: 5791 - protein, 24 aa, Artificial Sequence
  Description of Artificial Sequence: Synthetic signal sequence
MVLLVTSLLLCELPHPAFLLIPDT

SEQ ID NO: 5792 - DNA, 54 bp, Homo sapiens; identical to SEQ ID NO: 1850

SEQ ID NO: 5793 - DNA, 63 bp, Homo sapiens; identical to SEQ ID NO: 1321

SEQ ID NO: 5794 - DNA, 63 bp, Artificial Sequence; identical to SEQ ID NO: 1322
  Description of Artificial Sequence: Synthetic signal sequence

SEQ ID NO: 5795 - DNA, 63 bp, Artificial Sequence; identical to SEQ ID NO: 1323
  Description of Artificial Sequence: Synthetic signal sequence

SEQ ID NO: 5796 - DNA, 63 bp, Artificial Sequence; identical to SEQ ID NO: 1324
  Description of Artificial Sequence: Synthetic signal sequence

SEQ ID NO: 5797 - DNA, 63 bp, Artificial Sequence; identical to SEQ ID NO: 1325
  Description of Artificial Sequence: Synthetic signal sequence

SEQ ID NO: 5798 - DNA, 63 bp, Artificial Sequence; identical to SEQ ID NO: 1326
  Description of Artificial Sequence: Synthetic signal sequence

SEQ ID NO: 5799 - DNA, 63 bp, Artificial Sequence; identical to SEQ ID NO: 1327
  Description of Artificial Sequence: Synthetic signal sequence

SEQ ID NO: 5800 - DNA, 63 bp, Artificial Sequence; identical to SEQ ID NO: 1328
  Description of Artificial Sequence: Synthetic signal sequence

SEQ ID NO: 5801 - protein, 30 aa, Artificial Sequence; identical to SEQ ID NO: 1919
  Description of Artificial Sequence: Synthetic signal sequence

SEQ ID NO: 5802 - DNA, 90 bp, Artificial Sequence; identical to SEQ ID NO: 1724
  Description of Artificial Sequence: Synthetic signal sequence

SEQ ID NO: 5803 - DNA, 54 bp, Homo sapiens; identical to SEQ ID NO: 1850

SEQ ID NO: 5804 - DNA, 54 bp, Artificial Sequence; identical to SEQ ID NO: 1851
  Description of Artificial Sequence: Synthetic signal sequence

SEQ ID NO: 5805 - DNA, 54 bp, Artificial Sequence; identical to SEQ ID NO: 1852
  Description of Artificial Sequence: Synthetic signal sequence

SEQ ID NO: 5806 - DNA, 90 bp, Artificial Sequence; identical to SEQ ID NO: 1724
  Description of Artificial Sequence: Synthetic signal sequence

SEQ ID NO: 5807 - protein, 21 aa, Homo sapiens
MALPVTALLLPLALLLHAARP

SEQ ID NO: 5808 - DNA, 63 bp, Homo sapiens; identical to SEQ ID NO: 1321

SEQ ID NO: 5809 - DNA, 63 bp, Artificial Sequence; identical to SEQ ID NO: 1322
  Description of Artificial Sequence: Synthetic signal sequence

SEQ ID NO: 5810 - DNA, 63 bp, Artificial Sequence; identical to SEQ ID NO: 1323
  Description of Artificial Sequence: Synthetic signal sequence

SEQ ID NO: 5811 - DNA, 63 bp, Artificial Sequence; identical to SEQ ID NO: 1324
  Description of Artificial Sequence: Synthetic signal sequence

SEQ ID NO: 5812 - DNA, 63 bp, Artificial Sequence; identical to SEQ ID NO: 1325
  Description of Artificial Sequence: Synthetic signal sequence

SEQ ID NO: 5813 - protein, 18 aa, Homo sapiens
MDWTWILFLVAAATRVHS

SEQ ID NO: 5814 - DNA, 54 bp, Homo sapiens; identical to SEQ ID NO: 1850

SEQ ID NO: 5815 - DNA, 63 bp, Homo sapiens; identical to SEQ ID NO: 1321

SEQ ID NO: 5816 - DNA, 63 bp, Artificial Sequence; identical to SEQ ID NO: 1322
  Description of Artificial Sequence: Synthetic signal sequence

SEQ ID NO: 5817 - DNA, 63 bp, Artificial Sequence; identical to SEQ ID NO: 1323
  Description of Artificial Sequence: Synthetic signal sequence

SEQ ID NO: 5818 - DNA, 63 bp, Artificial Sequence; identical to SEQ ID NO: 1324
  Description of Artificial Sequence: Synthetic signal sequence

SEQ ID NO: 5819 - DNA, 63 bp, Artificial Sequence; identical to SEQ ID NO: 1325
  Description of Artificial Sequence: Synthetic signal sequence

SEQ ID NO: 5820 - DNA, 63 bp, Artificial Sequence; identical to SEQ ID NO: 1754
  Description of Artificial Sequence: Synthetic leader sequence

SEQ ID NO: 5821 - protein, 30 aa, Homo sapiens; identical to SEQ ID NO: 1919

SEQ ID NO: 5822 - DNA, 90 bp, Homo sapiens; identical to SEQ ID NO: 1724

SEQ ID NO: 5823 - DNA, 60 bp, Homo sapiens; identical to SEQ ID NO: 1776

SEQ ID NO: 5824 - DNA, 60 bp, Artificial Sequence; identical to SEQ ID NO: 1777
  Description of Artificial Sequence: Synthetic signal sequence

SEQ ID NO: 5825 - DNA, 60 bp, Artificial Sequence; identical to SEQ ID NO: 1778
  Description of Artificial Sequence: Synthetic signal sequence

SEQ ID NO: 5826 - DNA, 60 bp, Artificial Sequence; identical to SEQ ID NO: 1779
  Description of Artificial Sequence: Synthetic signal sequence

SEQ ID NO: 5827 - DNA, 66 bp, Homo sapiens; identical to SEQ ID NO: 1580

SEQ ID NO: 5828 - DNA, 66 bp, Artificial Sequence; identical to SEQ ID NO: 1581
  Description of Artificial Sequence: Synthetic signal sequence

SEQ ID NO: 5829 - DNA, 66 bp, Artificial Sequence; identical to SEQ ID NO: 1582
  Description of Artificial Sequence: Synthetic signal sequence

SEQ ID NO: 5830 - DNA, 66 bp, Artificial Sequence; identical to SEQ ID NO: 1583
  Description of Artificial Sequence: Synthetic signal sequence

SEQ ID NO: 5831 - DNA, 66 bp, Artificial Sequence; identical to SEQ ID NO: 1584
  Description of Artificial Sequence: Synthetic signal sequence

SEQ ID NO: 5832 - DNA, 66 bp, Artificial Sequence; identical to SEQ ID NO: 1585
  Description of Artificial Sequence: Synthetic signal sequence

SEQ ID NO: 5833 - DNA, 66 bp, Artificial Sequence; identical to SEQ ID NO: 1586
  Description of Artificial Sequence: Synthetic signal sequence

SEQ ID NO: 5834 - DNA, 66 bp, Artificial Sequence; identical to SEQ ID NO: 1587
  Description of Artificial Sequence: Synthetic signal sequence

SEQ ID NO: 5835 - DNA, 66 bp, Artificial Sequence; identical to SEQ ID NO: 1588
  Description of Artificial Sequence: Synthetic signal sequence

SEQ ID NO: 5836 - DNA, 54 bp, Homo sapiens; identical to SEQ ID NO: 1850

SEQ ID NO: 5837 - DNA, 54 bp, Homo sapiens; identical to SEQ ID NO: 1851

SEQ ID NO: 5838 - DNA, 54 bp, Homo sapiens; identical to SEQ ID NO: 1852

SEQ ID NO: 5839 - DNA, 63 bp, Homo sapiens; identical to SEQ ID NO: 1321

SEQ ID NO: 5840 - DNA, 63 bp, Artificial Sequence; identical to SEQ ID NO: 1322
  Description of Artificial Sequence: Synthetic signal sequence

SEQ ID NO: 5841 - DNA, 63 bp, Artificial Sequence; identical to SEQ ID NO: 1323
  Description of Artificial Sequence: Synthetic signal sequence

SEQ ID NO: 5842 - DNA, 63 bp, Artificial Sequence; identical to SEQ ID NO: 1324
  Description of Artificial Sequence: Synthetic signal sequence

SEQ ID NO: 5843 - DNA, 63 bp, Artificial Sequence; identical to SEQ ID NO: 1325
  Description of Artificial Sequence: Synthetic signal sequence

SEQ ID NO: 5844 - DNA, 90 bp, Artificial Sequence; identical to SEQ ID NO: 1724
  Description of Artificial Sequence: Synthetic construct

SEQ ID NO: 5845 - DNA, 27 bp, Homo sapiens
agcgccaggaatcgccagaagcggtcc

SEQ ID NO: 5846 - DNA, 24 bp, Homo sapiens
gcccggaatagacagaagagatct

SEQ ID NO: 5847 - DNA, 36 bp, Artificial Sequence; identical to SEQ ID NO: 1337
  Description of Artificial Sequence: Synthetic cleavage site

SEQ ID NO: 5848 - DNA, 36 bp, Artificial Sequence; identical to SEQ ID NO: 1338
  Description of Artificial Sequence: Synthetic cleavage site

SEQ ID NO: 5849 - DNA, 36 bp, Artificial Sequence; identical to SEQ ID NO: 1339
  Description of Artificial Sequence: Synthetic cleavage site

SEQ ID NO: 5850 - DNA, 42 bp, Artificial Sequence; identical to SEQ ID NO: 2359
  Description of Artificial Sequence: Synthetic cleavage site

SEQ ID NO: 5851 - DNA, 57 bp, Artificial Sequence; identical to SEQ ID NO: 2361
  Description of Artificial Sequence: Synthetic cleavage site

SEQ ID NO: 5852 - DNA, 27 bp, Homo sapiens
agcgccaggaatcgccagaagcggtcc

SEQ ID NO: 5853 - DNA, 24 bp, Homo sapiens
gcccggaatagacagaagagatct

SEQ ID NO: 5854 - DNA, 36 bp, Artificial Sequence; identical to SEQ ID NO: 1337
  Description of Artificial Sequence: Synthetic cleavage site

SEQ ID NO: 5855 - DNA, 36 bp, Artificial Sequence; identical to SEQ ID NO: 1338
  Description of Artificial Sequence: Synthetic cleavage site

SEQ ID NO: 5856 - DNA, 36 bp, Artificial Sequence; identical to SEQ ID NO: 1339
  Description of Artificial Sequence: Synthetic cleavage site

SEQ ID NO: 5857 - DNA, 57 bp, Artificial Sequence; identical to SEQ ID NO: 2361
  Description of Artificial Sequence: Synthetic cleavage site

SEQ ID NO: 5858 - DNA, 42 bp, Artificial Sequence; identical to SEQ ID NO: 2359
  Description of Artificial Sequence: Synthetic cleavage site

SEQ ID NO: 5859 - DNA, 60 bp, Artificial Sequence; identical to SEQ ID NO: 1806
  Description of Artificial Sequence: Synthetic cleavage site

SEQ ID NO: 5860 - DNA, 27 bp, Homo sapiens
agcgccaggaatcgccagaagcggtcc

SEQ ID NO: 5861 - DNA, 24 bp, Homo sapiens
gcccggaatagacagaagagatct

SEQ ID NO: 5862 - DNA, 36 bp, Artificial Sequence; identical to SEQ ID NO: 1337
  Description of Artificial Sequence: Synthetic cleavage site

SEQ ID NO: 5863 - DNA, 36 bp, Artificial Sequence; identical to SEQ ID NO: 1338
  Description of Artificial Sequence: Synthetic cleavage site

SEQ ID NO: 5864 - DNA, 36 bp, Artificial Sequence; identical to SEQ ID NO: 1339
  Description of Artificial Sequence: Synthetic cleavage site

SEQ ID NO: 5865 - DNA, 27 bp, Artificial Sequence
  Description of Artificial Sequence: Synthetic HA Tag
tacccatacgatgttccagattacgct

SEQ ID NO: 5866 - DNA, 27 bp, Artificial Sequence
  Description of Artificial Sequence: Synthetic HA Tag
tatccttacgatgtgcccgactatgct

SEQ ID NO: 5867 - DNA, 27 bp, Artificial Sequence
  Description of Artificial Sequence: Synthetic HA Tag
tatccgtacgacgtaccagactacgca

SEQ ID NO: 5868 - DNA, 12 bp, Artificial Sequence
  Description of Artificial Sequence: Synthetic linker
ggaggatctgga

SEQ ID NO: 5869 - DNA, 15 bp, Artificial Sequence
  Description of Artificial Sequence: Synthetic linker
ggaggcagcggagga

SEQ ID NO: 5870 - DNA, 15 bp, Artificial Sequence
  Description of Artificial Sequence: Synthetic linker
ggaggctctggagga

SEQ ID NO: 5871 - DNA, 15 bp, Artificial Sequence
  Description of Artificial Sequence: Synthetic linker
ggaggctccggcgga

SEQ ID NO: 5872 - DNA, 15 bp, Artificial Sequence
  Description of Artificial Sequence: Synthetic linker
ggaggatccggaggc

SEQ ID NO: 5873 - DNA, 15 bp, Artificial Sequence
  Description of Artificial Sequence: Synthetic linker
ggaggatctggagga

SEQ ID NO: 5874 - DNA, 18 bp, Artificial Sequence
  Description of Artificial Sequence: Synthetic oligonucleotide
ggtggctctggtggtggt

SEQ ID NO: 5875 - DNA, 18 bp, Artificial Sequence
  Description of Artificial Sequence: Synthetic oligonucleotide
ggaggtagtggtggaggc

SEQ ID NO: 5876 - DNA, 15 bp, Artificial Sequence
  Description of Artificial Sequence: Synthetic linker
tcaggtggcggtagt

SEQ ID NO: 5877 - DNA, 27 bp, Artificial Sequence
  Description of Artificial Sequence: Synthetic linker
ggaggtagtggtggaggcagtggtgga

SEQ ID NO: 5878 - DNA, 78 bp, Artificial Sequence; identical to SEQ ID NO: 1647
  Description of Artificial Sequence: Synthetic linker

SEQ ID NO: 5879 - DNA, 18 bp, Artificial Sequence
  Description of Artificial Sequence: Synthetic linker
gagttcagcaccgagttt

SEQ ID NO: 5880 - DNA, 18 bp, Artificial Sequence
  Description of Artificial Sequence: Synthetic linker
gagttctccaccgagttc

SEQ ID NO: 5881 - DNA, 15 bp, Artificial Sequence
  Description of Artificial Sequence: Synthetic linker
agcggcggtggcagc

SEQ ID NO: 5882 - DNA, 39 bp, Artificial Sequence; identical to SEQ ID NO: 2274
  Description of Artificial Sequence: Synthetic linker

SEQ ID NO: 5883 - DNA, 105 bp, Artificial Sequence; identical to SEQ ID NO: 2419
  Description of Artificial Sequence: Synthetic linker

SEQ ID NO: 5884 - DNA, 24 bp, Artificial Sequence
  Description of Artificial Sequence: Synthetic linker
gactacaaagacgatgacgacaag

SEQ ID NO: 5885 - DNA, 102 bp, Artificial Sequence; identical to SEQ ID NO: 1925
  Description of Artificial Sequence: Synthetic linker

SEQ ID NO: 5886 - DNA, 45 bp, Artificial Sequence; identical to SEQ ID NO: 1636
  Description of Artificial Sequence: Synthetic linker

SEQ ID NO: 5887 - DNA, 45 bp, Artificial Sequence; identical to SEQ ID NO: 1637
  Description of Artificial Sequence: Synthetic linker

SEQ ID NO: 5888 - DNA, 45 bp, Artificial Sequence; identical to SEQ ID NO: 1638
  Description of Artificial Sequence: Synthetic linker

SEQ ID NO: 5889 - DNA, 45 bp, Artificial Sequence; identical to SEQ ID NO: 1639
  Description of Artificial Sequence: Synthetic linker

SEQ ID NO: 5890 - DNA, 45 bp, Artificial Sequence; identical to SEQ ID NO: 1640
  Description of Artificial Sequence: Synthetic linker

SEQ ID NO: 5891 - DNA, 45 bp, Artificial Sequence; identical to SEQ ID NO: 1641
  Description of Artificial Sequence: Synthetic linker

SEQ ID NO: 5892 - DNA, 102 bp, Artificial Sequence; identical to SEQ ID NO: 2425
  Description of Artificial Sequence: Synthetic linker

SEQ ID NO: 5893 - DNA, 66 bp, Artificial Sequence; identical to SEQ ID NO: 2427
  Description of Artificial Sequence: Synthetic linker

SEQ ID NO: 5894 - DNA, 102 bp, Artificial Sequence; identical to SEQ ID NO: 1925
  Description of Artificial Sequence: Synthetic linker

SEQ ID NO: 5895 - DNA, 105 bp, Artificial Sequence; identical to SEQ ID NO: 2419
  Description of Artificial Sequence: Synthetic Linker sequence

SEQ ID NO: 5896 - DNA, 24 bp, Artificial Sequence
  Description of Artificial Sequence: Synthetic Linker sequence
gactacaaagacgatgacgacaag

SEQ ID NO: 5897 - DNA, 102 bp, Artificial Sequence; identical to SEQ ID NO: 1925
  Description of Artificial Sequence: Synthetic Linker sequence

SEQ ID NO: 5898 - DNA, 102 bp, Artificial Sequence; identical to SEQ ID NO: 2425
  Description of Artificial Sequence: Synthetic Linker sequence

SEQ ID NO: 5899 - DNA, 66 bp, Artificial Sequence; identical to SEQ ID NO: 2427
  Description of Artificial Sequence: Synthetic Linker sequence

SEQ ID NO: 5900 - DNA, 60 bp, Artificial Sequence; identical to SEQ ID NO: 1927
  Description of Artificial Sequence: Synthetic linker

SEQ ID NO: 5901 - DNA, 60 bp, Artificial Sequence; identical to SEQ ID NO: 1927
  Description of Artificial Sequence: Synthetic Linker sequence

SEQ ID NO: 5902 - DNA, 39 bp, Artificial Sequence; identical to SEQ ID NO: 2280
  Description of Artificial Sequence: Synthetic Linker sequence

SEQ ID NO: 5903 - DNA, 12 bp, Artificial Sequence
  Description of Artificial Sequence: Synthetic Linker sequence
gctagcttcgaa

SEQ ID NO: 5904 - DNA, 12 bp, Artificial Sequence
  Description of Artificial Sequence: Synthetic Linker sequence
ggaggatctgga

SEQ ID NO: 5905 - DNA, 15 bp, Artificial Sequence
  Description of Artificial Sequence: Synthetic Linker sequence
ggaggcagcggagga

SEQ ID NO: 5906 - DNA, 15 bp, Artificial Sequence
  Description of Artificial Sequence: Synthetic Linker sequence
ggaggctctggagga

SEQ ID NO: 5907 - DNA, 15 bp, Artificial Sequence
  Description of Artificial Sequence: Synthetic Linker sequence
ggaggctccggcgga

SEQ ID NO: 5908 - DNA, 15 bp, Artificial Sequence
  Description of Artificial Sequence: Synthetic Linker sequence
ggaggatccggaggc

SEQ ID NO: 5909 - DNA, 15 bp, Artificial Sequence
  Description of Artificial Sequence: Synthetic Linker sequence
ggaggatctggagga

SEQ ID NO: 5910 - DNA, 18 bp, Artificial Sequence
  Description of Artificial Sequence: Synthetic Linker sequence
ggtggctctggtggtggt

SEQ ID NO: 5911 - DNA, 18 bp, Artificial Sequence
  Description of Artificial Sequence: Synthetic Linker sequence
ggaggtagtggtggaggc

SEQ ID NO: 5912 - DNA, 15 bp, Artificial Sequence
  Description of Artificial Sequence: Synthetic Linker sequence
tcaggtggcggtagt

SEQ ID NO: 5913 - DNA, 15 bp, Artificial Sequence
  Description of Artificial Sequence: Synthetic Linker sequence
agcggcggtggcagc

SEQ ID NO: 5914 - DNA, 15 bp, Artificial Sequence
  Description of Artificial Sequence: Synthetic Linker sequence
tcaggcggggggagt

SEQ ID NO: 5915 - DNA, 27 bp, Artificial Sequence
  Description of Artificial Sequence: Synthetic Linker sequence
ggaggtagtggtggaggcagtggtgga

SEQ ID NO: 5916 - DNA, 45 bp, Artificial Sequence; identical to SEQ ID NO: 1636
  Description of Artificial Sequence: Synthetic Linker sequence

SEQ ID NO: 5917 - DNA, 45 bp, Artificial Sequence; identical to SEQ ID NO: 1637
  Description of Artificial Sequence: Synthetic Linker sequence

SEQ ID NO: 5918 - protein, 26 aa, Artificial Sequence
  Description of Artificial Sequence: Synthetic Linker sequence
SGGGSGGGGSGGGGSGGGGSGGGSLQ

SEQ ID NO: 5919 - DNA, 45 bp, Artificial Sequence; identical to SEQ ID NO: 1639
  Description of Artificial Sequence: Synthetic signal sequence

SEQ ID NO: 5920 - DNA, 45 bp, Artificial Sequence; identical to SEQ ID NO: 1640
  Description of Artificial Sequence: Synthetic Linker sequence

SEQ ID NO: 5921 - DNA, 45 bp, Artificial Sequence; identical to SEQ ID NO: 1641
  Description of Artificial Sequence: Synthetic Linker sequence

SEQ ID NO: 5922 - DNA, 78 bp, Artificial Sequence; identical to SEQ ID NO: 1647
  Description of Artificial Sequence: Synthetic Linker sequence

SEQ ID NO: 5923 - DNA, 78 bp, Artificial Sequence; identical to SEQ ID NO: 1648
  Description of Artificial Sequence: Synthetic Linker sequence

SEQ ID NO: 5924 - DNA, 78 bp, Artificial Sequence; identical to SEQ ID NO: 1649
  Description of Artificial Sequence: Synthetic Linker sequence

SEQ ID NO: 5925 - DNA, 78 bp, Artificial Sequence; identical to SEQ ID NO: 1650
  Description of Artificial Sequence: Synthetic Linker sequence

SEQ ID NO: 5926 - DNA, 78 bp, Artificial Sequence; identical to SEQ ID NO: 1651
  Description of Artificial Sequence: Synthetic Linker sequence

SEQ ID NO: 5927 - DNA, 78 bp, Artificial Sequence; identical to SEQ ID NO: 1652
  Description of Artificial Sequence: Synthetic Linker sequence

SEQ ID NO: 5928 - DNA, 78 bp, Artificial Sequence; identical to SEQ ID NO: 1650
  Description of Artificial Sequence: Synthetic Linker sequence

SEQ ID NO: 5929 - DNA, 18 bp, Artificial Sequence
  Description of Artificial Sequence: Synthetic Linker sequence
gagttcagcaccgagttt

SEQ ID NO: 5930 - DNA, 18 bp, Artificial Sequence
  Description of Artificial Sequence: Synthetic Linker sequence
gagttctccaccgagttc

SEQ ID NO: 5931 - DNA, 39 bp, Artificial Sequence; identical to SEQ ID NO: 2274
  Description of Artificial Sequence: Synthetic signal sequence

SEQ ID NO: 5932 - DNA, 105 bp, Artificial Sequence; identical to SEQ ID NO: 2419
  Description of Artificial Sequence: Synthetic Linker sequence

SEQ ID NO: 5933 - DNA, 24 bp, Artificial Sequence
  Description of Artificial Sequence: Synthetic Linker sequence
gactacaaagacgatgacgacaag

SEQ ID NO: 5934 - DNA, 102 bp, Artificial Sequence; identical to SEQ ID NO: 1925
  Description of Artificial Sequence: Synthetic Linker sequence

SEQ ID NO: 5935 - DNA, 102 bp, Artificial Sequence; identical to SEQ ID NO: 2425
  Description of Artificial Sequence: Synthetic Linker sequence

SEQ ID NO: 5936 - DNA, 66 bp, Artificial Sequence; identical to SEQ ID NO: 2427
  Description of Artificial Sequence: Synthetic Linker sequence

SEQ ID NO: 5937 - DNA, 60 bp, Artificial Sequence; identical to SEQ ID NO: 1927
  Description of Artificial Sequence: Synthetic Linker sequence

SEQ ID NO: 5938 - DNA, 39 bp, Artificial Sequence; identical to SEQ ID NO: 2280
  Description of Artificial Sequence: Synthetic Linker sequence

SEQ ID NO: 5939 - DNA, 12 bp, Artificial Sequence
  Description of Artificial Sequence: Synthetic Linker sequence
gctagcttcgaa

SEQ ID NO: 5940 - DNA, 60 bp, Artificial Sequence; identical to SEQ ID NO: 1806
  Description of Artificial Sequence: Synthetic Cleavable peptide

SEQ ID NO: 5941 - DNA, 561 bp, Artificial Sequence; identical to SEQ ID NO: 72
  Description of Artificial Sequence: Synthetic destabilizing domain (DD)

SEQ ID NO: 5942 - DNA, 561 bp, Artificial Sequence; identical to SEQ ID NO: 73
  Description of Artificial Sequence: Synthetic destabilizing domain (DD)

SEQ ID NO: 5943 - DNA, 561 bp, Artificial Sequence; identical to SEQ ID NO: 74
  Description of Artificial Sequence: Synthetic destabilizing domain (DD)

SEQ ID NO: 5944 - DNA, 561 bp, Artificial Sequence; identical to SEQ ID NO: 75
  Description of Artificial Sequence: Synthetic destabilizing domain (DD)

SEQ ID NO: 5945 - DNA, 561 bp, Artificial Sequence; identical to SEQ ID NO: 76
  Description of Artificial Sequence: Synthetic destabilizing domain (DD)

SEQ ID NO: 5946 - DNA, 561 bp, Artificial Sequence; identical to SEQ ID NO: 77
  Description of Artificial Sequence: Synthetic destabilizing domain (DD)

SEQ ID NO: 5947 - DNA, 561 bp, Artificial Sequence; identical to SEQ ID NO: 78
  Description of Artificial Sequence: Synthetic destabilizing domain (DD)

SEQ ID NO: 5948 - DNA, 561 bp, Artificial Sequence; identical to SEQ ID NO: 79
  Description of Artificial Sequence: Synthetic destabilizing domain (DD)

SEQ ID NO: 5949 - DNA, 561 bp, Artificial Sequence; identical to SEQ ID NO: 80
  Description of Artificial Sequence: Synthetic destabilizing domain (DD)

SEQ ID NO: 5950 - DNA, 561 bp, Artificial Sequence; identical to SEQ ID NO: 81
  Description of Artificial Sequence: Synthetic destabilizing domain (DD)

SEQ ID NO: 5951 - DNA, 561 bp, Artificial Sequence; identical to SEQ ID NO: 82
  Description of Artificial Sequence: Synthetic destabilizing domain (DD)

SEQ ID NO: 5952 - DNA, 561 bp, Artificial Sequence; identical to SEQ ID NO: 83
  Description of Artificial Sequence: Synthetic destabilizing domain (DD)

SEQ ID NO: 5953 - DNA, 561 bp, Artificial Sequence; identical to SEQ ID NO: 84
  Description of Artificial Sequence: Synthetic destabilizing domain (DD)

SEQ ID NO: 5954 - DNA, 561 bp, Artificial Sequence; identical to SEQ ID NO: 85
  Description of Artificial Sequence: Synthetic destabilizing domain (DD)

SEQ ID NO: 5955 - DNA, 558 bp, Artificial Sequence; identical to SEQ ID NO: 86
  Description of Artificial Sequence: Synthetic destabilizing domain (DD)

SEQ ID NO: 5956 - DNA, 2034 bp, Artificial Sequence; identical to SEQ ID NO: 165
  Description of Artificial Sequence: Synthetic Construct

SEQ ID NO: 5957 - DNA, 2034 bp, Artificial Sequence; identical to SEQ ID NO: 166
  Description of Artificial Sequence: Synthetic Construct

SEQ ID NO: 5958 - DNA, 2034 bp, Artificial Sequence; identical to SEQ ID NO: 167
  Description of Artificial Sequence: Synthetic Construct

SEQ ID NO: 5959 - DNA, 2034 bp, Artificial Sequence; identical to SEQ ID NO: 1707
  Description of Artificial Sequence: Synthetic Construct

SEQ ID NO: 5960 - DNA, 2062 bp, Artificial Sequence; identical to SEQ ID NO: 174
  Description of Artificial Sequence: Synthetic Construct

SEQ ID NO: 5961 - DNA, 2062 bp, Artificial Sequence; identical to SEQ ID NO: 175
  Description of Artificial Sequence: Synthetic Construct

SEQ ID NO: 5962 - DNA, 2061 bp, Artificial Sequence; identical to SEQ ID NO: 176
  Description of Artificial Sequence: Synthetic Construct

SEQ ID NO: 5963 - DNA, 2061 bp, Artificial Sequence; identical to SEQ ID NO: 177
  Description of Artificial Sequence: Synthetic Construct

SEQ ID NO: 5964 - DNA, 1188 bp, Artificial Sequence; identical to SEQ ID NO: 169
  Description of Artificial Sequence: Synthetic polynucleotide

SEQ ID NO: 5965 - DNA, 1752 bp, Artificial Sequence; identical to SEQ ID NO: 170
  Description of Artificial Sequence: Synthetic polynucleotide

SEQ ID NO: 5966 - DNA, 1752 bp, Artificial Sequence; identical to SEQ ID NO: 171
  Description of Artificial Sequence: Synthetic polynucleotide

SEQ ID NO: 5967 - DNA, 1623 bp, Artificial Sequence; identical to SEQ ID NO: 172
  Description of Artificial Sequence: Synthetic polynucleotide

SEQ ID NO: 5968 - DNA, 2214 bp, Artificial Sequence; identical to SEQ ID NO: 173
  Description of Artificial Sequence: Synthetic polynucleotide

SEQ ID NO: 5969 - DNA, 1824 bp, Artificial Sequence; identical to SEQ ID NO: 178
  Description of Artificial Sequence: Synthetic polynucleotide

SEQ ID NO: 5970 - DNA, 1824 bp, Artificial Sequence; identical to SEQ ID NO: 179
  Description of Artificial Sequence: Synthetic polynucleotide

SEQ ID NO: 5971 - DNA, 1824 bp, Artificial Sequence; identical to SEQ ID NO: 180
  Description of Artificial Sequence: Synthetic polynucleotide

SEQ ID NO: 5972 - DNA, 321 bp, Artificial Sequence; identical to SEQ ID NO: 1664
  Description of Artificial Sequence: Synthetic Destabilizing Domain (DD)

SEQ ID NO: 5973 - DNA, 321 bp, Artificial Sequence; identical to SEQ ID NO: 1665
  Description of Artificial Sequence: Synthetic Destabilizing Domain (DD)

SEQ ID NO: 5974 - DNA, 321 bp, Artificial Sequence; identical to SEQ ID NO: 1666
  Description of Artificial Sequence: Synthetic Destabilizing Domain (DD)

SEQ ID NO: 5975 - DNA, 324 bp, Artificial Sequence; identical to SEQ ID NO: 1669
  Description of Artificial Sequence: Synthetic Destabilizing Domain (DD)

SEQ ID NO: 5976 - DNA, 324 bp, Artificial Sequence; identical to SEQ ID NO: 1670
  Description of Artificial Sequence: Synthetic Destabilizing Domain (DD)

SEQ ID NO: 5977 - DNA, 324 bp, Artificial Sequence; identical to SEQ ID NO: 1671
  Description of Artificial Sequence: Synthetic Destabilizing Domain (DD)

SEQ ID NO: 5978 - DNA, 324 bp, Artificial Sequence; identical to SEQ ID NO: 1672
  Description of Artificial Sequence: Synthetic Destabilizing Domain (DD)

SEQ ID NO: 5979 - DNA, 321 bp, Artificial Sequence; identical to SEQ ID NO: 1667
  Description of Artificial Sequence: Synthetic Destabilizing Domain (DD)

SEQ ID NO: 5980 - DNA, 474 bp, Artificial Sequence; identical to SEQ ID NO: 1680
  Description of Artificial Sequence: Synthetic Destabilizing Domain (DD)

SEQ ID NO: 5981 - DNA, 321 bp, Artificial Sequence; identical to SEQ ID NO: 1668
  Description of Artificial Sequence: Synthetic Destabilizing Domain (DD)

SEQ ID NO: 5982 - DNA, 321 bp, Artificial Sequence; identical to SEQ ID NO: 1673
  Description of Artificial Sequence: Synthetic Destabilizing Domain (DD)

SEQ ID NO: 5983 - DNA, 321 bp, Artificial Sequence; identical to SEQ ID NO: 1674
  Description of Artificial Sequence: Synthetic Destabilizing Domain (DD)

SEQ ID NO: 5984 - DNA, 321 bp, Artificial Sequence; identical to SEQ ID NO: 1675
  Description of Artificial Sequence: Synthetic Destabilizing Domain (DD)

SEQ ID NO: 5985 - DNA, 474 bp, Artificial Sequence; identical to SEQ ID NO: 1679
  Description of Artificial Sequence: Synthetic Destabilizing Domain (DD)

SEQ ID NO: 5986 - DNA, 474 bp, Artificial Sequence; identical to SEQ ID NO: 1676
  Description of Artificial Sequence: Synthetic Destabilizing Domain (DD)

SEQ ID NO: 5987 - DNA, 477 bp, Artificial Sequence; identical to SEQ ID NO: 1677
  Description of Artificial Sequence: Synthetic Destabilizing Domain (DD)

SEQ ID NO: 5988 - DNA, 477 bp, Artificial Sequence; identical to SEQ ID NO: 1682
  Description of Artificial Sequence: Synthetic Destabilizing Domain (DD)

SEQ ID NO: 5989 - DNA, 474 bp, Artificial Sequence; identical to SEQ ID NO: 1678
  Description of Artificial Sequence: Synthetic Destabilizing Domain (DD)

SEQ ID NO: 5990 - DNA, 474 bp, Artificial Sequence; identical to SEQ ID NO: 1683
  Description of Artificial Sequence: Synthetic Destabilizing Domain (DD)

SEQ ID NO: 5991 - DNA, 474 bp, Artificial Sequence; identical to SEQ ID NO: 1680
  Description of Artificial Sequence: Synthetic Destabilizing Domain (DD)

SEQ ID NO: 5992 - DNA, 474 bp, Artificial Sequence; identical to SEQ ID NO: 1681
  Description of Artificial Sequence: Synthetic Destabilizing Domain (DD)

SEQ ID NO: 5993 - DNA, 474 bp, Artificial Sequence; identical to SEQ ID NO: 1684
  Description of Artificial Sequence: Synthetic Destabilizing Domain (DD)

SEQ ID NO: 5994 - DNA, 561 bp, Artificial Sequence; identical to SEQ ID NO: 73
  Description of Artificial Sequence: Synthetic Destabilizing Domain (DD)

SEQ ID NO: 5995 - DNA, 558 bp, Artificial Sequence; identical to SEQ ID NO: 1685
  Description of Artificial Sequence: Synthetic Destabilizing Domain (DD)

SEQ ID NO: 5996 - DNA, 561 bp, Artificial Sequence; identical to SEQ ID NO: 76
  Description of Artificial Sequence: Synthetic Destabilizing Domain (DD)

SEQ ID NO: 5997 - DNA, 561 bp, Artificial Sequence; identical to SEQ ID NO: 77
  Description of Artificial Sequence: Synthetic Destabilizing Domain (DD)

SEQ ID NO: 5998 - DNA, 561 bp, Artificial Sequence; identical to SEQ ID NO: 82
  Description of Artificial Sequence: Synthetic Destabilizing Domain (DD)

SEQ ID NO: 5999 - DNA, 561 bp, Artificial Sequence; identical to SEQ ID NO: 83
  Description of Artificial Sequence: Synthetic Destabilizing Domain (DD)

SEQ ID NO: 6000 - DNA, 561 bp, Artificial Sequence; identical to SEQ ID NO: 84
  Description of Artificial Sequence: Synthetic Destabilizing Domain (DD)

SEQ ID NO: 6001 - DNA, 561 bp, Artificial Sequence; identical to SEQ ID NO: 85
  Description of Artificial Sequence: Synthetic Destabilizing Domain (DD)

SEQ ID NO: 6002 - DNA, 558 bp, Artificial Sequence; identical to SEQ ID NO: 86
  Description of Artificial Sequence: Synthetic Destabilizing Domain (DD)

SEQ ID NO: 6003 - DNA, 561 bp, Artificial Sequence; identical to SEQ ID NO: 74
  Description of Artificial Sequence: Synthetic Destabilizing Domain (DD)

SEQ ID NO: 6004 - DNA, 561 bp, Artificial Sequence; identical to SEQ ID NO: 80
  Description of Artificial Sequence: Synthetic Destabilizing Domain (DD)

SEQ ID NO: 6005 - DNA, 561 bp, Artificial Sequence; identical to SEQ ID NO: 78
  Description of Artificial Sequence: Synthetic Destabilizing Domain (DD)

SEQ ID NO: 6006 - DNA, 561 bp, Artificial Sequence; identical to SEQ ID NO: 75
  Description of Artificial Sequence: Synthetic Destabilizing Domain (DD)

SEQ ID NO: 6007 - DNA, 561 bp, Artificial Sequence; identical to SEQ ID NO: 79
  Description of Artificial Sequence: Synthetic Destabilizing Domain (DD)

SEQ ID NO: 6008 - DNA, 561 bp, Artificial Sequence; identical to SEQ ID NO: 81
  Description of Artificial Sequence: Synthetic Destabilizing Domain (DD)

SEQ ID NO: 6009 - DNA, 561 bp, Artificial Sequence; identical to SEQ ID NO: 93
  Description of Artificial Sequence: Synthetic Destabilizing Domain (DD)

SEQ ID NO: 6010 - DNA, 561 bp, Artificial Sequence; identical to SEQ ID NO: 92
  Description of Artificial Sequence: Synthetic Destabilizing Domain (DD)

SEQ ID NO: 6011 - DNA, 561 bp, Artificial Sequence; identical to SEQ ID NO: 94
  Description of Artificial Sequence: Synthetic Destabilizing Domain (DD)

SEQ ID NO: 6012 - DNA, 561 bp, Artificial Sequence; identical to SEQ ID NO: 90
  Description of Artificial Sequence: Synthetic Destabilizing Domain (DD)

SEQ ID NO: 6013 - DNA, 561 bp, Artificial Sequence; identical to SEQ ID NO: 96
  Description of Artificial Sequence: Synthetic Destabilizing Domain (DD)

SEQ ID NO: 6014 - DNA, 561 bp, Artificial Sequence; identical to SEQ ID NO: 98
  Description of Artificial Sequence: Synthetic Destabilizing Domain (DD)

SEQ ID NO: 6015 - DNA, 561 bp, Artificial Sequence; identical to SEQ ID NO: 110
  Description of Artificial Sequence: Synthetic Destabilizing Domain (DD)

SEQ ID NO: 6016 - DNA, 561 bp, Artificial Sequence; identical to SEQ ID NO: 99
  Description of Artificial Sequence: Synthetic Destabilizing Domain (DD)

SEQ ID NO: 6017 - DNA, 561 bp, Artificial Sequence; identical to SEQ ID NO: 103
  Description of Artificial Sequence: Synthetic Destabilizing Domain (DD)

SEQ ID NO: 6018 - DNA, 561 bp, Artificial Sequence; identical to SEQ ID NO: 97
  Description of Artificial Sequence: Synthetic Destabilizing Domain (DD)

SEQ ID NO: 6019 - DNA, 561 bp, Artificial Sequence; identical to SEQ ID NO: 95
  Description of Artificial Sequence: Synthetic Destabilizing Domain (DD)

SEQ ID NO: 6020 - DNA, 561 bp, Artificial Sequence; identical to SEQ ID NO: 112
  Description of Artificial Sequence: Synthetic Destabilizing Domain (DD)

SEQ ID NO: 6021 - DNA, 561 bp, Artificial Sequence; identical to SEQ ID NO: 111
  Description of Artificial Sequence: Synthetic Destabilizing Domain (DD)

SEQ ID NO: 6022 - DNA, 561 bp, Artificial Sequence; identical to SEQ ID NO: 100
  Description of Artificial Sequence: Synthetic Destabilizing Domain (DD)

SEQ ID NO: 6023 - DNA, 561 bp, Artificial Sequence; identical to SEQ ID NO: 108
  Description of Artificial Sequence: Synthetic Destabilizing Domain (DD)

SEQ ID NO: 6024 - DNA, 561 bp, Artificial Sequence; identical to SEQ ID NO: 113
  Description of Artificial Sequence: Synthetic Destabilizing Domain (DD)

SEQ ID NO: 6025 - DNA, 561 bp, Artificial Sequence; identical to SEQ ID NO: 91
  Description of Artificial Sequence: Synthetic Destabilizing Domain (DD)

SEQ ID NO: 6026 - DNA, 561 bp, Artificial Sequence; identical to SEQ ID NO: 101
  Description of Artificial Sequence: Synthetic Destabilizing Domain (DD)

SEQ ID NO: 6027 - DNA, 561 bp, Artificial Sequence; identical to SEQ ID NO: 105
  Description of Artificial Sequence: Synthetic Destabilizing Domain (DD)

SEQ ID NO: 6028 - DNA, 561 bp, Artificial Sequence; identical to SEQ ID NO: 102
  Description of Artificial Sequence: Synthetic Destabilizing Domain (DD)

SEQ ID NO: 6029 - DNA, 561 bp, Artificial Sequence; identical to SEQ ID NO: 104
  Description of Artificial Sequence: Synthetic Destabilizing Domain (DD)

SEQ ID NO: 6030 - DNA, 561 bp, Artificial Sequence; identical to SEQ ID NO: 106
  Description of Artificial Sequence: Synthetic Destabilizing Domain (DD)

SEQ ID NO: 6031 - DNA, 561 bp, Artificial Sequence; identical to SEQ ID NO: 109
  Description of Artificial Sequence: Synthetic Destabilizing Domain (DD)

SEQ ID NO: 6032 - DNA, 561 bp, Artificial Sequence; identical to SEQ ID NO: 114
  Description of Artificial Sequence: Synthetic Destabilizing Domain (DD)

SEQ ID NO: 6033 - DNA, 561 bp, Artificial Sequence; identical to SEQ ID NO: 115
  Description of Artificial Sequence: Synthetic Destabilizing Domain (DD)

SEQ ID NO: 6034 - DNA, 561 bp, Artificial Sequence; identical to SEQ ID NO: 116
  Description of Artificial Sequence: Synthetic Destabilizing Domain (DD)

SEQ ID NO: 6035 - DNA, 561 bp, Artificial Sequence; identical to SEQ ID NO: 117
  Description of Artificial Sequence: Synthetic Destabilizing Domain (DD)

SEQ ID NO: 6036 - DNA, 561 bp, Artificial Sequence; identical to SEQ ID NO: 118
  Description of Artificial Sequence: Synthetic Destabilizing Domain (DD)

SEQ ID NO: 6037 - DNA, 561 bp, Artificial Sequence; identical to SEQ ID NO: 119
  Description of Artificial Sequence: Synthetic Destabilizing Domain (DD)

SEQ ID NO: 6038 - DNA, 561 bp, Artificial Sequence; identical to SEQ ID NO: 120
  Description of Artificial Sequence: Synthetic Destabilizing Domain (DD)

SEQ ID NO: 6039 - DNA, 561 bp, Artificial Sequence; identical to SEQ ID NO: 121
  Description of Artificial Sequence: Synthetic Destabilizing Domain (DD)

SEQ ID NO: 6040 - DNA, 561 bp, Artificial Sequence; identical to SEQ ID NO: 122
  Description of Artificial Sequence: Synthetic Destabilizing Domain (DD)

SEQ ID NO: 6041 - DNA, 561 bp, Artificial Sequence; identical to SEQ ID NO: 123
  Description of Artificial Sequence: Synthetic Destabilizing Domain (DD)

SEQ ID NO: 6042 - DNA, 561 bp, Artificial Sequence; identical to SEQ ID NO: 124
  Description of Artificial Sequence: Synthetic Destabilizing Domain (DD)

SEQ ID NO: 6043 - DNA, 558 bp, Artificial Sequence; identical to SEQ ID NO: 125
  Description of Artificial Sequence: Synthetic Destabilizing Domain (DD)

SEQ ID NO: 6044 - DNA, 558 bp, Artificial Sequence; identical to SEQ ID NO: 126
  Description of Artificial Sequence: Synthetic Destabilizing Domain (DD)

SEQ ID NO: 6045 - DNA, 561 bp, Artificial Sequence; identical to SEQ ID NO: 1944
  Description of Artificial Sequence: Synthetic Destabilizing Domain (DD)

SEQ ID NO: 6046 - DNA, 561 bp, Artificial Sequence; identical to SEQ ID NO: 1944
  Description of Artificial Sequence: Synthetic Destabilizing Domain (DD)

SEQ ID NO: 6047 - DNA, 558 bp, Artificial Sequence; identical to SEQ ID NO: 1943
  Description of Artificial Sequence: Synthetic Destabilizing Domain (DD)

SEQ ID NO: 6048 - DNA, 561 bp, Artificial Sequence; identical to SEQ ID NO: 1688
  Description of Artificial Sequence: Synthetic Destabilizing Domain (DD)

SEQ ID NO: 6049 - DNA, 558 bp, Artificial Sequence; identical to SEQ ID NO: 1689
  Description of Artificial Sequence: Synthetic Destabilizing Domain (DD)

SEQ ID NO: 6050 - DNA, 561 bp, Artificial Sequence; identical to SEQ ID NO: 1694
  Description of Artificial Sequence: Synthetic Destabilizing Domain (DD)

SEQ ID NO: 6051 - DNA, 558 bp, Artificial Sequence; identical to SEQ ID NO: 1695
  Description of Artificial Sequence: Synthetic Destabilizing Domain (DD)

SEQ ID NO: 6052 - DNA, 558 bp, Artificial Sequence; identical to SEQ ID NO: 1946
  Description of Artificial Sequence: Synthetic Destabilizing Domain (DD)

SEQ ID NO: 6053 - DNA, 558 bp, Artificial Sequence; identical to SEQ ID NO: 1948
  Description of Artificial Sequence: Synthetic Destabilizing Domain (DD)

SEQ ID NO: 6054 - DNA, 558 bp, Artificial Sequence; identical to SEQ ID NO: 1820
  Description of Artificial Sequence: Synthetic Destabilizing Domain (DD)

SEQ ID NO: 6055 - DNA, 561 bp, Artificial Sequence; identical to SEQ ID NO: 107
  Description of Artificial Sequence: Synthetic Destabilizing Domain (DD)

SEQ ID NO: 6056 - DNA, 558 bp, Artificial Sequence; identical to SEQ ID NO: 1686
  Description of Artificial Sequence: Synthetic Destabilizing Domain (DD)

SEQ ID NO: 6057 - DNA, 558 bp, Artificial Sequence; identical to SEQ ID NO: 1690
  Description of Artificial Sequence: Synthetic Destabilizing Domain (DD)

SEQ ID NO: 6058 - DNA, 558 bp, Artificial Sequence; identical to SEQ ID NO: 1692
  Description of Artificial Sequence: Synthetic Destabilizing Domain (DD)

SEQ ID NO: 6059 - DNA, 558 bp, Artificial Sequence; identical to SEQ ID NO: 1696
  Description of Artificial Sequence: Synthetic Destabilizing Domain (DD)

SEQ ID NO: 6060 - DNA, 1461 bp, Artificial Sequence; identical to SEQ ID NO: 1697
  Description of Artificial Sequence: Synthetic Construct

SEQ ID NO: 6061 - DNA, 1782 bp, Artificial Sequence; identical to SEQ ID NO: 1698
  Description of Artificial Sequence: Synthetic Construct

SEQ ID NO: 6062 - DNA, 1935 bp, Artificial Sequence; identical to SEQ ID NO: 1699
  Description of Artificial Sequence: Synthetic Construct

SEQ ID NO: 6063 - DNA, 1782 bp, Artificial Sequence; identical to SEQ ID NO: 1700
  Description of Artificial Sequence: Synthetic Construct

SEQ ID NO: 6064 - DNA, 1935 bp, Artificial Sequence; identical to SEQ ID NO: 1701
  Description of Artificial Sequence: Synthetic Construct

SEQ ID NO: 6065 - DNA, 1950 bp, Artificial Sequence; identical to SEQ ID NO: 1702
  Description of Artificial Sequence: Synthetic Construct

SEQ ID NO: 6066 - DNA, 1797 bp, Artificial Sequence; identical to SEQ ID NO: 1703
  Description of Artificial Sequence: Synthetic Construct

SEQ ID NO: 6067 - DNA, 2034 bp, Artificial Sequence; identical to SEQ ID NO: 165
  Description of Artificial Sequence: Synthetic Construct

SEQ ID NO: 6068 - DNA, 2034 bp, Artificial Sequence; identical to SEQ ID NO: 166
  Description of Artificial Sequence: Synthetic Construct

SEQ ID NO: 6069 - DNA, 2034 bp, Artificial Sequence; identical to SEQ ID NO: 167
  Description of Artificial Sequence: Synthetic Construct

SEQ ID NO: 6070 - DNA, 2034 bp, Artificial Sequence; identical to SEQ ID NO: 1707
  Description of Artificial Sequence: Synthetic Construct

SEQ ID NO: 6071 - DNA, 1824 bp, Artificial Sequence; identical to SEQ ID NO: 1708
  Description of Artificial Sequence: Synthetic Construct

SEQ ID NO: 6072 - DNA, 1977 bp, Artificial Sequence; identical to SEQ ID NO: 1709
  Description of Artificial Sequence: Synthetic Construct

SEQ ID NO: 6073 - DNA, 2061 bp, Artificial Sequence; identical to SEQ ID NO: 176
  Description of Artificial Sequence: Synthetic Construct

SEQ ID NO: 6074 - DNA, 2061 bp, Artificial Sequence; identical to SEQ ID NO: 177
  Description of Artificial Sequence: Synthetic Construct

SEQ ID NO: 6075 - DNA, 1959 bp, Artificial Sequence; identical to SEQ ID NO: 1822
  Description of Artificial Sequence: Synthetic Construct

SEQ ID NO: 6076 - DNA, 1962 bp, Artificial Sequence; identical to SEQ ID NO: 1824
  Description of Artificial Sequence: Synthetic Construct

SEQ ID NO: 6077 - DNA, 1971 bp, Artificial Sequence; identical to SEQ ID NO: 1826
  Description of Artificial Sequence: Synthetic Construct

SEQ ID NO: 6078 - DNA, 1968 bp, Artificial Sequence; identical to SEQ ID NO: 1828
  Description of Artificial Sequence: Synthetic Construct

SEQ ID NO: 6079 - DNA, 1956 bp, Artificial Sequence; identical to SEQ ID NO: 1830
  Description of Artificial Sequence: Synthetic Construct

SEQ ID NO: 6080 - DNA, 1623 bp, Artificial Sequence; identical to SEQ ID NO: 172
  Description of Artificial Sequence: Synthetic Construct

SEQ ID NO: 6081 - DNA, 2130 bp, Artificial Sequence; identical to SEQ ID NO: 1834
  Description of Artificial Sequence: Synthetic Construct

SEQ ID NO: 6082 - DNA, 2214 bp, Artificial Sequence; identical to SEQ ID NO: 173
  Description of Artificial Sequence: Synthetic Construct

SEQ ID NO: 6083 - DNA, 1980 bp, Artificial Sequence; identical to SEQ ID NO: 1838
  Description of Artificial Sequence: Synthetic Construct

SEQ ID NO: 6084 - DNA, 432 bp, Artificial Sequence; identical to SEQ ID NO: 1861
  Description of Artificial Sequence: Synthetic polynucleotide

SEQ ID NO: 6085 - DNA, 405 bp, Artificial Sequence; identical to SEQ ID NO: 1857
  Description of Artificial Sequence: Synthetic polynucleotide

SEQ ID NO: 6086 - DNA, 912 bp, Artificial Sequence; identical to SEQ ID NO: 1859
  Description of Artificial Sequence: Synthetic polynucleotide

SEQ ID NO: 6087 - DNA, 1170 bp, Artificial Sequence; identical to SEQ ID NO: 1863
  Description of Artificial Sequence: Synthetic polynucleotide

SEQ ID NO: 6088 - DNA, 1734 bp, Artificial Sequence; identical to SEQ ID NO: 1865
  Description of Artificial Sequence: Synthetic polynucleotide

SEQ ID NO: 6089 - DNA, 1668 bp, Artificial Sequence; identical to SEQ ID NO: 2107
  Description of Artificial Sequence: Synthetic polynucleotide

SEQ ID NO: 6090 - DNA, 1515 bp, Artificial Sequence; identical to SEQ ID NO: 1952
  Description of Artificial Sequence: Synthetic polynucleotide

SEQ ID NO: 6091 - DNA, 1188 bp, Artificial Sequence; identical to SEQ ID NO: 169
  Description of Artificial Sequence: Synthetic polynucleotide

SEQ ID NO: 6092 - DNA, 1668 bp, Artificial Sequence; identical to SEQ ID NO: 1956
  Description of Artificial Sequence: Synthetic polynucleotide

SEQ ID NO: 6093 - DNA, 1752 bp, Artificial Sequence; identical to SEQ ID NO: 170
  Description of Artificial Sequence: Synthetic polynucleotide

SEQ ID NO: 6094 - DNA, 1752 bp, Artificial Sequence; identical to SEQ ID NO: 171
  Description of Artificial Sequence: Synthetic polynucleotide

SEQ ID NO: 6095 - DNA, 1752 bp, Artificial Sequence; identical to SEQ ID NO: 1962
  Description of Artificial Sequence: Synthetic Construct

SEQ ID NO: 6096 - DNA, 1752 bp, Artificial Sequence; identical to SEQ ID NO: 1964
  Description of Artificial Sequence: Synthetic Construct

SEQ ID NO: 6097 - DNA, 1752 bp, Artificial Sequence; identical to SEQ ID NO: 1966
  Description of Artificial Sequence: Synthetic Construct

SEQ ID NO: 6098 - DNA, 1215 bp, Artificial Sequence; identical to SEQ ID NO: 1968
  Description of Artificial Sequence: Synthetic Construct

SEQ ID NO: 6099 - DNA, 1212 bp, Artificial Sequence; identical to SEQ ID NO: 1970
  Description of Artificial Sequence: Synthetic Construct

SEQ ID NO: 6100 - DNA, 1212 bp, Artificial Sequence; identical to SEQ ID NO: 1972
  Description of Artificial Sequence: Synthetic Construct

SEQ ID NO: 6101 - DNA, 1116 bp, Artificial Sequence; identical to SEQ ID NO: 1974
  Description of Artificial Sequence: Synthetic Construct

SEQ ID NO: 6102 - DNA, 1224 bp, Artificial Sequence; identical to SEQ ID NO: 1976
  Description of Artificial Sequence: Synthetic Construct

SEQ ID NO: 6103 - DNA, 1194 bp, Artificial Sequence; identical to SEQ ID NO: 1978
  Description of Artificial Sequence: Synthetic Construct

SEQ ID NO: 6104 - DNA, 1668 bp, Artificial Sequence; identical to SEQ ID NO: 1980
  Description of Artificial Sequence: Synthetic Construct

SEQ ID NO: 6105 - DNA, 1224 bp, Artificial Sequence; identical to SEQ ID NO: 1982
  Description of Artificial Sequence: Synthetic Construct

SEQ ID NO: 6106 - DNA, 1722 bp, Artificial Sequence; identical to SEQ ID NO: 1985
  Description of Artificial Sequence: Synthetic Construct

SEQ ID NO: 6107 - DNA, 1245 bp, Artificial Sequence; identical to SEQ ID NO: 1987
  Description of Artificial Sequence: Synthetic Construct

SEQ ID NO: 6108 - DNA, 1806 bp, Artificial Sequence; identical to SEQ ID NO: 1989
  Description of Artificial Sequence: Synthetic Construct

SEQ ID NO: 6109 - DNA, 1806 bp, Artificial Sequence; identical to SEQ ID NO: 1991
  Description of Artificial Sequence: Synthetic Construct

SEQ ID NO: 6110 - DNA, 1806 bp, Artificial Sequence; identical to SEQ ID NO: 1993
  Description of Artificial Sequence: Synthetic Construct

SEQ ID NO: 6111 - DNA, 1806 bp, Artificial Sequence; identical to SEQ ID NO: 1995
  Description of Artificial Sequence: Synthetic Construct

SEQ ID NO: 6112 - DNA, 1806 bp, Artificial Sequence; identical to SEQ ID NO: 1997
  Description of Artificial Sequence: Synthetic Construct

SEQ ID NO: 6113 - DNA, 1806 bp, Artificial Sequence; identical to SEQ ID NO: 1999
  Description of Artificial Sequence: Synthetic Construct

SEQ ID NO: 6114 - DNA, 2046 bp, Artificial Sequence; identical to SEQ ID NO: 2001
  Description of Artificial Sequence: Synthetic Construct

SEQ ID NO: 6115 - DNA, 1959 bp, Artificial Sequence; identical to SEQ ID NO: 2003
  Description of Artificial Sequence: Synthetic Construct

SEQ ID NO: 6116 - DNA, 2291 bp, Artificial Sequence; identical to SEQ ID NO: 2020
  Description of Artificial Sequence: Synthetic Construct

SEQ ID NO: 6117 - DNA, 1735 bp, Artificial Sequence; identical to SEQ ID NO: 2035
  Description of Artificial Sequence: Synthetic Construct

SEQ ID NO: 6118 - DNA, 321 bp, Artificial Sequence; identical to SEQ ID NO: 1664
  Description of Artificial Sequence: Synthetic Destabilizing Domain (DD)

SEQ ID NO: 6119 - DNA, 321 bp, Artificial Sequence; identical to SEQ ID NO: 1666
  Description of Artificial Sequence: Synthetic Destabilizing Domain (DD)

SEQ ID NO: 6120 - DNA, 321 bp, Artificial Sequence; identical to SEQ ID NO: 1667
  Description of Artificial Sequence: Synthetic Destabilizing Domain (DD)

SEQ ID NO: 6121 - DNA, 324 bp, Artificial Sequence; identical to SEQ ID NO: 1669
  Description of Artificial Sequence: Synthetic Destabilizing Domain (DD)

SEQ ID NO: 6122 - DNA, 324 bp, Artificial Sequence; identical to SEQ ID NO: 1670
  Description of Artificial Sequence: Synthetic Destabilizing Domain (DD)

SEQ ID NO: 6123 - DNA, 324 bp, Artificial Sequence; identical to SEQ ID NO: 1671
  Description of Artificial Sequence: Synthetic Destabilizing Domain (DD)

SEQ ID NO: 6124 - DNA, 324 bp, Artificial Sequence; identical to SEQ ID NO: 1672
  Description of Artificial Sequence: Synthetic Destabilizing Domain (DD)

SEQ ID NO: 6125 - DNA, 474 bp, Artificial Sequence; identical to SEQ ID NO: 1676
  Description of Artificial Sequence: Synthetic Destabilizing Domain (DD)

SEQ ID NO: 6126 - DNA, 477 bp, Artificial Sequence; identical to SEQ ID NO: 1677
  Description of Artificial Sequence: Synthetic Destabilizing Domain (DD)

SEQ ID NO: 6127 - DNA, 477 bp, Artificial Sequence; identical to SEQ ID NO: 1682
  Description of Artificial Sequence: Synthetic Destabilizing Domain (DD)

SEQ ID NO: 6128 - DNA, 474 bp, Artificial Sequence; identical to SEQ ID NO: 1678
  Description of Artificial Sequence: Synthetic Destabilizing Domain (DD)

SEQ ID NO: 6129 - DNA, 474 bp, Artificial Sequence; identical to SEQ ID NO: 1683
  Description of Artificial Sequence: Synthetic Destabilizing Domain (DD)

SEQ ID NO: 6130 - DNA, 561 bp, Artificial Sequence; identical to SEQ ID NO: 77
  Description of Artificial Sequence: Synthetic Destabilizing Domain (DD)

SEQ ID NO: 6131 - DNA, 561 bp, Artificial Sequence; identical to SEQ ID NO: 85
  Description of Artificial Sequence: Synthetic Destabilizing Domain (DD)

SEQ ID NO: 6132 - DNA, 561 bp, Artificial Sequence; identical to SEQ ID NO: 73
  Description of Artificial Sequence: Synthetic Destabilizing Domain (DD)

SEQ ID NO: 6133 - DNA, 561 bp, Artificial Sequence; identical to SEQ ID NO: 82
  Description of Artificial Sequence: Synthetic Destabilizing Domain (DD)

SEQ ID NO: 6134 - DNA, 561 bp, Artificial Sequence; identical to SEQ ID NO: 74
  Description of Artificial Sequence: Synthetic Destabilizing Domain (DD)

SEQ ID NO: 6135 - DNA, 561 bp, Artificial Sequence; identical to SEQ ID NO: 80
  Description of Artificial Sequence: Synthetic Destabilizing Domain (DD)

SEQ ID NO: 6136 - DNA, 561 bp, Artificial Sequence; identical to SEQ ID NO: 78
  Description of Artificial Sequence: Synthetic Destabilizing Domain (DD)

SEQ ID NO: 6137 - DNA, 561 bp, Artificial Sequence; identical to SEQ ID NO: 75
  Description of Artificial Sequence: Synthetic Destabilizing Domain (DD)

SEQ ID NO: 6138 - DNA, 561 bp, Artificial Sequence; identical to SEQ ID NO: 79
  Description of Artificial Sequence: Synthetic Destabilizing Domain (DD)

SEQ ID NO: 6139 - DNA, 561 bp, Artificial Sequence; identical to SEQ ID NO: 81
  Description of Artificial Sequence: Synthetic Destabilizing Domain (DD)

SEQ ID NO: 6140 - DNA, 561 bp, Artificial Sequence; identical to SEQ ID NO: 76
  Description of Artificial Sequence: Synthetic Destabilizing Domain (DD)

SEQ ID NO: 6141 - DNA, 561 bp, Artificial Sequence; identical to SEQ ID NO: 84
  Description of Artificial Sequence: Synthetic Destabilizing Domain (DD)

SEQ ID NO: 6142 - DNA, 558 bp, Artificial Sequence; identical to SEQ ID NO: 86
  Description of Artificial Sequence: Synthetic Destabilizing Domain (DD)

SEQ ID NO: 6143 - DNA, 558 bp, Artificial Sequence; identical to SEQ ID NO: 1685
  Description of Artificial Sequence: Synthetic Destabilizing Domain (DD)

SEQ ID NO: 6144 - DNA, 561 bp, Artificial Sequence; identical to SEQ ID NO: 1688
  Description of Artificial Sequence: Synthetic Destabilizing Domain (DD)

SEQ ID NO: 6145 - DNA, 558 bp, Artificial Sequence; identical to SEQ ID NO: 1689
  Description of Artificial Sequence: Synthetic Destabilizing Domain (DD)

SEQ ID NO: 6146 - DNA, 561 bp, Artificial Sequence; identical to SEQ ID NO: 1694
  Description of Artificial Sequence: Synthetic Destabilizing Domain (DD)

SEQ ID NO: 6147 - DNA, 558 bp, Artificial Sequence; identical to SEQ ID NO: 1695
  Description of Artificial Sequence: Synthetic Destabilizing Domain (DD)

SEQ ID NO: 6148 - DNA, 558 bp, Artificial Sequence; identical to SEQ ID NO: 1943
  Description of Artificial Sequence: Synthetic Destabilizing Domain (DD)

SEQ ID NO: 6149 - DNA, 561 bp, Artificial Sequence; identical to SEQ ID NO: 1944
  Description of Artificial Sequence: Synthetic Destabilizing Domain (DD)

SEQ ID NO: 6150 - DNA, 561 bp, Artificial Sequence; identical to SEQ ID NO: 1944
  Description of Artificial Sequence: Synthetic Destabilizing Domain (DD)

SEQ ID NO: 6151 - DNA, 561 bp, Artificial Sequence; identical to SEQ ID NO: 107
  Description of Artificial Sequence: Synthetic Destabilizing Domain (DD)

SEQ ID NO: 6152 - DNA, 558 bp, Artificial Sequence; identical to SEQ ID NO: 1946
  Description of Artificial Sequence: Synthetic Destabilizing Domain (DD)

SEQ ID NO: 6153 - DNA, 558 bp, Artificial Sequence; identical to SEQ ID NO: 1820
  Description of Artificial Sequence: Synthetic Destabilizing Domain (DD)

SEQ ID NO: 6154 - DNA, 558 bp, Artificial Sequence; identical to SEQ ID NO: 126
  Description of Artificial Sequence: Synthetic Destabilizing Domain (DD)

SEQ ID NO: 6155 - DNA, 558 bp, Artificial Sequence; identical to SEQ ID NO: 1948
  Description of Artificial Sequence: Synthetic Destabilizing Domain (DD)

SEQ ID NO: 6156 - DNA, 405 bp, Artificial Sequence; identical to SEQ ID NO: 1857
  Description of Artificial Sequence: Synthetic polynucleotide

SEQ ID NO: 6157 - DNA, 912 bp, Artificial Sequence; identical to SEQ ID NO: 1859
  Description of Artificial Sequence: Synthetic polynucleotide

SEQ ID NO: 6158 - DNA, 1170 bp, Artificial Sequence; identical to SEQ ID NO: 1863
  Description of Artificial Sequence: Synthetic polynucleotide

SEQ ID NO: 6159 - protein, 577 aa, Artificial Sequence; identical to SEQ ID NO: 1864
  Description of Artificial Sequence: Synthetic polypeptide

SEQ ID NO: 6160 - DNA, 1734 bp, Artificial Sequence; identical to SEQ ID NO: 1865
  Description of Artificial Sequence: Synthetic polynucleotide

SEQ ID NO: 6161 - DNA, 1668 bp, Artificial Sequence; identical to SEQ ID NO: 2107
  Description of Artificial Sequence: Synthetic polynucleotide

SEQ ID NO: 6162 - DNA, 1515 bp, Artificial Sequence; identical to SEQ ID NO: 1952
  Description of Artificial Sequence: Synthetic polynucleotide

SEQ ID NO: 6163 - DNA, 1188 bp, Artificial Sequence; identical to SEQ ID NO: 169
  Description of Artificial Sequence: Synthetic polynucleotide

SEQ ID NO: 6164 - DNA, 1668 bp, Artificial Sequence; identical to SEQ ID NO: 1956
  Description of Artificial Sequence: Synthetic polynucleotide

SEQ ID NO: 6165 - DNA, 1752 bp, Artificial Sequence; identical to SEQ ID NO: 170
  Description of Artificial Sequence: Synthetic polynucleotide

SEQ ID NO: 6166 - DNA, 1752 bp, Artificial Sequence; identical to SEQ ID NO: 171
  Description of Artificial Sequence: Synthetic polynucleotide

SEQ ID NO: 6167 - DNA, 432 bp, Artificial Sequence; identical to SEQ ID NO: 1861
  Description of Artificial Sequence: Synthetic polynucleotide

SEQ ID NO: 6168 - DNA, 561 bp, Artificial Sequence; identical to SEQ ID NO: 1944
  Description of Artificial Sequence: Synthetic Destabilizing Domain (DD)

SEQ ID NO: 6169 - DNA, 1752 bp, Artificial Sequence; identical to SEQ ID NO: 1962
  Description of Artificial Sequence: Synthetic construct

SEQ ID NO: 6170 - DNA, 1752 bp, Artificial Sequence; identical to SEQ ID NO: 1966
  Description of Artificial Sequence: Synthetic construct

SEQ ID NO: 6171 - DNA, 1215 bp, Artificial Sequence; identical to SEQ ID NO: 1968
  Description of Artificial Sequence: Synthetic construct

SEQ ID NO: 6172 - DNA, 1212 bp, Artificial Sequence; identical to SEQ ID NO: 1970
  Description of Artificial Sequence: Synthetic construct

SEQ ID NO: 6173 - DNA, 1212 bp, Artificial Sequence; identical to SEQ ID NO: 1972
  Description of Artificial Sequence: Synthetic construct

SEQ ID NO: 6174 - DNA, 1116 bp, Artificial Sequence; identical to SEQ ID NO: 1974
  Description of Artificial Sequence: Synthetic construct

SEQ ID NO: 6175 - DNA, 1224 bp, Artificial Sequence; identical to SEQ ID NO: 1976
  Description of Artificial Sequence: Synthetic construct

SEQ ID NO: 6176 - DNA, 1194 bp, Artificial Sequence; identical to SEQ ID NO: 1978
  Description of Artificial Sequence: Synthetic construct

SEQ ID NO: 6177 - DNA, 1668 bp, Artificial Sequence; identical to SEQ ID NO: 1980
  Description of Artificial Sequence: Synthetic construct

SEQ ID NO: 6178 - DNA, 1224 bp, Artificial Sequence; identical to SEQ ID NO: 1976
  Description of Artificial Sequence: Synthetic construct

SEQ ID NO: 6179 - DNA, 1116 bp, Artificial Sequence; identical to SEQ ID NO: 2141
  Description of Artificial Sequence: Synthetic construct

SEQ ID NO: 6180 - DNA, 1224 bp, Artificial Sequence; identical to SEQ ID NO: 1982
  Description of Artificial Sequence: Synthetic construct

SEQ ID NO: 6181 - DNA, 1188 bp, Artificial Sequence; identical to SEQ ID NO: 5582
  Description of Artificial Sequence: Synthetic construct

SEQ ID NO: 6182 - DNA, 1722 bp, Artificial Sequence; identical to SEQ ID NO: 1985
  Description of Artificial Sequence: Synthetic construct

SEQ ID NO: 6183 - DNA, 1245 bp, Artificial Sequence; identical to SEQ ID NO: 1987
  Description of Artificial Sequence: Synthetic construct

SEQ ID NO: 6184 - DNA, 1806 bp, Artificial Sequence; identical to SEQ ID NO: 1989
  Description of Artificial Sequence: Synthetic construct

SEQ ID NO: 6185 - DNA, 1806 bp, Artificial Sequence; identical to SEQ ID NO: 1991
  Description of Artificial Sequence: Synthetic construct

SEQ ID NO: 6186 - DNA, 1806 bp, Artificial Sequence; identical to SEQ ID NO: 1993
  Description of Artificial Sequence: Synthetic construct

SEQ ID NO: 6187 - DNA, 1806 bp, Artificial Sequence; identical to SEQ ID NO: 1995
  Description of Artificial Sequence: Synthetic construct

SEQ ID NO: 6188 - DNA, 321 bp, Artificial Sequence; identical to SEQ ID NO: 1664
  Description of Artificial Sequence: Synthetic Destabilized Domain (DD)

SEQ ID NO: 6189 - DNA, 321 bp, Artificial Sequence; identical to SEQ ID NO: 1665
  Description of Artificial Sequence: Synthetic Destabilized Domain (DD)

SEQ ID NO: 6190 - DNA, 321 bp, Artificial Sequence; identical to SEQ ID NO: 1666
  Description of Artificial Sequence: Synthetic Destabilized Domain (DD)

SEQ ID NO: 6191 - DNA, 324 bp, Artificial Sequence; identical to SEQ ID NO: 1669
  Description of Artificial Sequence: Synthetic Destabilizing Domain (DD)

SEQ ID NO: 6192 - DNA, 324 bp, Artificial Sequence; identical to SEQ ID NO: 1670
  Description of Artificial Sequence: Synthetic Destabilizing Domain (DD)

SEQ ID NO: 6193 - DNA, 324 bp, Artificial Sequence; identical to SEQ ID NO: 1671
  Description of Artificial Sequence: Synthetic Destabilizing Domain (DD)

SEQ ID NO: 6194 - DNA, 558 bp, Artificial Sequence; identical to SEQ ID NO: 86
  Description of Artificial Sequence: Synthetic Destabilizing Domain (DD)

SEQ ID NO: 6195 - DNA, 561 bp, Artificial Sequence; identical to SEQ ID NO: 73
  Description of Artificial Sequence: Synthetic Destabilizing Domain (DD)

SEQ ID NO: 6196 - DNA, 561 bp, Artificial Sequence; identical to SEQ ID NO: 82
  Description of Artificial Sequence: Synthetic Destabilizing Domain (DD)

SEQ ID NO: 6197 - DNA, 561 bp, Artificial Sequence; identical to SEQ ID NO: 74
  Description of Artificial Sequence: Synthetic Destabilizing Domain (DD)

SEQ ID NO: 6198 - DNA, 561 bp, Artificial Sequence; identical to SEQ ID NO: 80
  Description of Artificial Sequence: Synthetic Destabilizing Domain (DD)

SEQ ID NO: 6199 - DNA, 561 bp, Artificial Sequence; identical to SEQ ID NO: 78
  Description of Artificial Sequence: Synthetic Destabilizing Domain (DD)

SEQ ID NO: 6200 - DNA, 561 bp, Artificial Sequence; identical to SEQ ID NO: 75
  Description of Artificial Sequence: Synthetic Destabilizing Domain (DD)

SEQ ID NO: 6201 - DNA, 561 bp, Artificial Sequence; identical to SEQ ID NO: 79
  Description of Artificial Sequence: Synthetic Destabilizing Domain (DD)

SEQ ID NO: 6202 - DNA, 561 bp, Artificial Sequence; identical to SEQ ID NO: 81
  Description of Artificial Sequence: Synthetic Destabilizing Domain (DD)

SEQ ID NO: 6203 - DNA, 561 bp, Artificial Sequence; identical to SEQ ID NO: 76
  Description of Artificial Sequence: Synthetic Destabilizing Domain (DD)

SEQ ID NO: 6204 - DNA, 561 bp, Artificial Sequence; identical to SEQ ID NO: 84
  Description of Artificial Sequence: Synthetic Destabilizing Domain (DD)

SEQ ID NO: 6205 - DNA, 561 bp, Artificial Sequence; identical to SEQ ID NO: 91
  Description of Artificial Sequence: Synthetic Destabilizing Domain (DD)

SEQ ID NO: 6206 - DNA, 561 bp, Artificial Sequence; identical to SEQ ID NO: 92
  Description of Artificial Sequence: Synthetic Destabilizing Domain (DD)

SEQ ID NO: 6207 - DNA, 561 bp, Artificial Sequence; identical to SEQ ID NO: 93
  Description of Artificial Sequence: Synthetic Destabilizing Domain (DD)

SEQ ID NO: 6208 - DNA, 561 bp, Artificial Sequence; identical to SEQ ID NO: 94
  Description of Artificial Sequence: Synthetic Destabilizing Domain (DD)

SEQ ID NO: 6209 - DNA, 561 bp, Artificial Sequence; identical to SEQ ID NO: 95
  Description of Artificial Sequence: Synthetic Destabilizing Domain (DD)

SEQ ID NO: 6210 - DNA, 561 bp, Artificial Sequence; identical to SEQ ID NO: 96
  Description of Artificial Sequence: Synthetic Destabilizing Domain (DD)

SEQ ID NO: 6211 - DNA, 561 bp, Artificial Sequence; identical to SEQ ID NO: 97
  Description of Artificial Sequence: Synthetic Destabilizing Domain (DD)

SEQ ID NO: 6212 - DNA, 561 bp, Artificial Sequence; identical to SEQ ID NO: 98
  Description of Artificial Sequence: Synthetic Destabilizing Domain (DD)

SEQ ID NO: 6213 - DNA, 561 bp, Artificial Sequence; identical to SEQ ID NO: 99
  Description of Artificial Sequence: Synthetic Destabilizing Domain (DD)

SEQ ID NO: 6214 - DNA, 561 bp, Artificial Sequence; identical to SEQ ID NO: 100
  Description of Artificial Sequence: Synthetic Destabilizing Domain (DD)

SEQ ID NO: 6215 - DNA, 561 bp, Artificial Sequence; identical to SEQ ID NO: 101
  Description of Artificial Sequence: Synthetic Destabilizing Domain (DD)

SEQ ID NO: 6216 - DNA, 561 bp, Artificial Sequence; identical to SEQ ID NO: 102
  Description of Artificial Sequence: Synthetic Destabilizing Domain (DD)

SEQ ID NO: 6217 - DNA, 561 bp, Artificial Sequence; identical to SEQ ID NO: 103
  Description of Artificial Sequence: Synthetic Destabilizing Domain (DD)

SEQ ID NO: 6218 - DNA, 561 bp, Artificial Sequence; identical to SEQ ID NO: 104
  Description of Artificial Sequence: Synthetic Destabilizing Domain (DD)

SEQ ID NO: 6219 - DNA, 561 bp, Artificial Sequence; identical to SEQ ID NO: 105
  Description of Artificial Sequence: Synthetic Destabilizing Domain (DD)

SEQ ID NO: 6220 - DNA, 561 bp, Artificial Sequence; identical to SEQ ID NO: 106
  Description of Artificial Sequence: Synthetic Destabilizing Domain (DD)

SEQ ID NO: 6221 - DNA, 561 bp, Artificial Sequence; identical to SEQ ID NO: 107
  Description of Artificial Sequence: Synthetic Destabilizing Domain (DD)

SEQ ID NO: 6222 - DNA, 561 bp, Artificial Sequence; identical to SEQ ID NO: 108
  Description of Artificial Sequence: Synthetic Destabilizing Domain (DD)

SEQ ID NO: 6223 - DNA, 561 bp, Artificial Sequence; identical to SEQ ID NO: 109
  Description of Artificial Sequence: Synthetic Destabilizing Domain (DD)

SEQ ID NO: 6224 - DNA, 561 bp, Artificial Sequence; identical to SEQ ID NO: 110
  Description of Artificial Sequence: Synthetic Destabilizing Domain (DD)

SEQ ID NO: 6225 - DNA, 561 bp, Artificial Sequence; identical to SEQ ID NO: 111
  Description of Artificial Sequence: Synthetic Destabilizing Domain (DD)

SEQ ID NO: 6226 - DNA, 561 bp, Artificial Sequence; identical to SEQ ID NO: 112
  Description of Artificial Sequence: Synthetic Destabilizing Domain (DD)

SEQ ID NO: 6227 - DNA, 561 bp, Artificial Sequence; identical to SEQ ID NO: 113
  Description of Artificial Sequence: Synthetic Destabilizing Domain (DD)

SEQ ID NO: 6228 - DNA, 561 bp, Artificial Sequence; identical to SEQ ID NO: 114
  Description of Artificial Sequence: Synthetic Destabilizing Domain (DD)

SEQ ID NO: 6229 - DNA, 561 bp, Artificial Sequence; identical to SEQ ID NO: 115
  Description of Artificial Sequence: Synthetic Destabilizing Domain (DD)

SEQ ID NO: 6230 - DNA, 561 bp, Artificial Sequence; identical to SEQ ID NO: 116
  Description of Artificial Sequence: Synthetic Destabilizing Domain (DD)

SEQ ID NO: 6231 - DNA, 561 bp, Artificial Sequence; identical to SEQ ID NO: 117
  Description of Artificial Sequence: Synthetic Destabilizing Domain (DD)

SEQ ID NO: 6232 - DNA, 561 bp, Artificial Sequence; identical to SEQ ID NO: 118
  Description of Artificial Sequence: Synthetic Destabilizing Domain (DD)

SEQ ID NO: 6233 - DNA, 561 bp, Artificial Sequence; identical to SEQ ID NO: 119
  Description of Artificial Sequence: Synthetic Destabilizing Domain (DD)

SEQ ID NO: 6234 - DNA, 561 bp, Artificial Sequence; identical to SEQ ID NO: 120
  Description of Artificial Sequence: Synthetic Destabilizing Domain (DD)

SEQ ID NO: 6235 - DNA, 561 bp, Artificial Sequence; identical to SEQ ID NO: 121
  Description of Artificial Sequence: Synthetic Destabilizing Domain (DD)

SEQ ID NO: 6236 - DNA, 561 bp, Artificial Sequence; identical to SEQ ID NO: 122
  Description of Artificial Sequence: Synthetic Destabilizing Domain (DD)

SEQ ID NO: 6237 - DNA, 561 bp, Artificial Sequence; identical to SEQ ID NO: 123
  Description of Artificial Sequence: Synthetic Destabilizing Domain (DD)

SEQ ID NO: 6238 - DNA, 561 bp, Artificial Sequence; identical to SEQ ID NO: 124
  Description of Artificial Sequence: Synthetic Destabilizing Domain (DD)

SEQ ID NO: 6239 - DNA, 558 bp, Artificial Sequence; identical to SEQ ID NO: 125
  Description of Artificial Sequence: Synthetic Destabilizing Domain (DD)

SEQ ID NO: 6240 - DNA, 558 bp, Artificial Sequence; identical to SEQ ID NO: 1685
  Description of Artificial Sequence: Synthetic Destabilizing Domain (DD)

SEQ ID NO: 6241 - DNA, 1959 bp, Artificial Sequence; identical to SEQ ID NO: 1822
  Description of Artificial Sequence: Synthetic Construct

SEQ ID NO: 6242 - DNA, 1962 bp, Artificial Sequence; identical to SEQ ID NO: 1824
  Description of Artificial Sequence: Synthetic Construct

SEQ ID NO: 6243 - DNA, 1971 bp, Artificial Sequence; identical to SEQ ID NO: 1826
  Description of Artificial Sequence: Synthetic Construct

SEQ ID NO: 6244 - DNA, 1968 bp, Artificial Sequence; identical to SEQ ID NO: 1828
  Description of Artificial Sequence: Synthetic Construct

SEQ ID NO: 6245 - DNA, 1956 bp, Artificial Sequence; identical to SEQ ID NO: 1830
  Description of Artificial Sequence: Synthetic Construct

SEQ ID NO: 6246 - DNA, 1623 bp, Artificial Sequence; identical to SEQ ID NO: 172
  Description of Artificial Sequence: Synthetic Construct

SEQ ID NO: 6247 - DNA, 2130 bp, Artificial Sequence; identical to SEQ ID NO: 1834
  Description of Artificial Sequence: Synthetic Construct

SEQ ID NO: 6248 - DNA, 2214 bp, Artificial Sequence; identical to SEQ ID NO: 173
  Description of Artificial Sequence: Synthetic Construct

SEQ ID NO: 6249 - DNA, 1980 bp, Artificial Sequence; identical to SEQ ID NO: 1838
  Description of Artificial Sequence: Synthetic Construct

SEQ ID NO: 6250 - DNA, 405 bp, Artificial Sequence; identical to SEQ ID NO: 1857
  Description of Artificial Sequence: Synthetic polynucleotide

SEQ ID NO: 6251 - DNA, 912 bp, Artificial Sequence; identical to SEQ ID NO: 1859
  Description of Artificial Sequence: Synthetic polynucleotide

SEQ ID NO: 6252 - DNA, 432 bp, Artificial Sequence; identical to SEQ ID NO: 1861
  Description of Artificial Sequence: Synthetic polynucleotide

SEQ ID NO: 6253 - DNA, 1170 bp, Artificial Sequence; identical to SEQ ID NO: 1863
  Description of Artificial Sequence: Synthetic polynucleotide

SEQ ID NO: 6254 - DNA, 1734 bp, Artificial Sequence; identical to SEQ ID NO: 1865
  Description of Artificial Sequence: Synthetic polynucleotide

SEQ ID NO: 6255 - DNA, 321 bp, Artificial Sequence; identical to SEQ ID NO: 1786
  Description of Artificial Sequence: Synthetic Destabilized Domain (DD)

SEQ ID NO: 6256 - DNA, 321 bp, Artificial Sequence; identical to SEQ ID NO: 2283
  Description of Artificial Sequence: Synthetic Destabilizing Domain (DD)

SEQ ID NO: 6257 - DNA, 321 bp, Artificial Sequence; identical to SEQ ID NO: 1764
  Description of Artificial Sequence: Synthetic Destabilizing Domain (DD)

SEQ ID NO: 6258 - DNA, 321 bp, Artificial Sequence; identical to SEQ ID NO: 1664
  Description of Artificial Sequence: Synthetic Destabilizing Domain (DD)

SEQ ID NO: 6259 - DNA, 321 bp, Artificial Sequence; identical to SEQ ID NO: 1665
  Description of Artificial Sequence: Synthetic Destabilizing Domain (DD)

SEQ ID NO: 6260 - DNA, 321 bp, Artificial Sequence; identical to SEQ ID NO: 1666
  Description of Artificial Sequence: Synthetic Destabilizing Domain (DD)

SEQ ID NO: 6261 - DNA, 321 bp, Artificial Sequence; identical to SEQ ID NO: 1667
  Description of Artificial Sequence: Synthetic Destabilizing Domain (DD)

SEQ ID NO: 6262 - DNA, 321 bp, Artificial Sequence; identical to SEQ ID NO: 1668
  Description of Artificial Sequence: Synthetic Destabilizing Domain (DD)

SEQ ID NO: 6263 - DNA, 324 bp, Artificial Sequence; identical to SEQ ID NO: 1669
  Description of Artificial Sequence: Synthetic Destabilizing Domain (DD)

SEQ ID NO: 6264 - DNA, 324 bp, Artificial Sequence; identical to SEQ ID NO: 1670
  Description of Artificial Sequence: Synthetic Destabilizing Domain (DD)

SEQ ID NO: 6265 - DNA, 324 bp, Artificial Sequence; identical to SEQ ID NO: 1671
  Description of Artificial Sequence: Synthetic Destabilizing Domain (DD)

SEQ ID NO: 6266 - DNA, 324 bp, Artificial Sequence; identical to SEQ ID NO: 1672
  Description of Artificial Sequence: Synthetic Destabilizing Domain (DD)

SEQ ID NO: 6267 - DNA, 321 bp, Artificial Sequence; identical to SEQ ID NO: 1673
  Description of Artificial Sequence: Synthetic Destabilizing Domain (DD)

SEQ ID NO: 6268 - DNA, 321 bp, Artificial Sequence; identical to SEQ ID NO: 1674
  Description of Artificial Sequence: Synthetic Destabilizing Domain (DD)

SEQ ID NO: 6269 - DNA, 321 bp, Artificial Sequence; identical to SEQ ID NO: 1675
  Description of Artificial Sequence: Synthetic Destabilizing Domain (DD)

SEQ ID NO: 6270 - DNA, 474 bp, Artificial Sequence; identical to SEQ ID NO: 1678
  Description of Artificial Sequence: Synthetic Destabilized Domain (DD)

SEQ ID NO: 6271 - DNA, 477 bp, Artificial Sequence; identical to SEQ ID NO: 5683
  Description of Artificial Sequence: Synthetic Destabilizing Domain (DD)

SEQ ID NO: 6272 - DNA, 236 bp, Artificial Sequence; identical to SEQ ID NO: 2287
  Description of Artificial Sequence: Synthetic Destabilizing Domain (DD)

SEQ ID NO: 6273 - DNA, 474 bp, Artificial Sequence; identical to SEQ ID NO: 1676
  Description of Artificial Sequence: Synthetic Destabilizing Domain (DD)

SEQ ID NO: 6274 - DNA, 477 bp, Artificial Sequence; identical to SEQ ID NO: 1677
  Description of Artificial Sequence: Synthetic Destabilizing Domain (DD)

SEQ ID NO: 6275 - DNA, 474 bp, Artificial Sequence; identical to SEQ ID NO: 1678
  Description of Artificial Sequence: Synthetic Destabilizing Domain (DD)

SEQ ID NO: 6276 - DNA, 474 bp, Artificial Sequence; identical to SEQ ID NO: 1679
  Description of Artificial Sequence: Synthetic Destabilizing Domain (DD)

SEQ ID NO: 6277 - DNA, 474 bp, Artificial Sequence; identical to SEQ ID NO: 1680
  Description of Artificial Sequence: Synthetic Destabilizing Domain (DD)

SEQ ID NO: 6278 - DNA, 474 bp, Artificial Sequence; identical to SEQ ID NO: 1681
  Description of Artificial Sequence: Synthetic Destabilizing Domain (DD)

SEQ ID NO: 6279 - DNA, 477 bp, Artificial Sequence; identical to SEQ ID NO: 1682
  Description of Artificial Sequence: Synthetic Destabilizing Domain (DD)

SEQ ID NO: 6280 - DNA, 474 bp, Artificial Sequence; identical to SEQ ID NO: 1683
  Description of Artificial Sequence: Synthetic Destabilizing Domain (DD)

SEQ ID NO: 6281 - DNA, 474 bp, Artificial Sequence; identical to SEQ ID NO: 1684
  Description of Artificial Sequence: Synthetic Destabilizing Domain (DD)

SEQ ID NO: 6282 - DNA, 561 bp, Artificial Sequence; identical to SEQ ID NO: 73
  Description of Artificial Sequence: Synthetic Destabilizing Domain (DD)

SEQ ID NO: 6283 - DNA, 561 bp, Artificial Sequence; identical to SEQ ID NO: 75
  Description of Artificial Sequence: Synthetic Destabilizing Domain (DD)

SEQ ID NO: 6284 - DNA, 561 bp, Artificial Sequence; identical to SEQ ID NO: 79
  Description of Artificial Sequence: Synthetic Destabilizing Domain (DD)

SEQ ID NO: 6285 - DNA, 561 bp, Artificial Sequence; identical to SEQ ID NO: 82
  Description of Artificial Sequence: Synthetic Destabilizing Domain (DD)

SEQ ID NO: 6286 - DNA, 561 bp, Artificial Sequence; identical to SEQ ID NO: 83
  Description of Artificial Sequence: Synthetic Destabilizing Domain (DD)

SEQ ID NO: 6287 - DNA, 561 bp, Artificial Sequence; identical to SEQ ID NO: 76
  Description of Artificial Sequence: Synthetic Destabilizing Domain (DD)

SEQ ID NO: 6288 - DNA, 561 bp, Artificial Sequence; identical to SEQ ID NO: 77
  Description of Artificial Sequence: Synthetic Destabilizing Domain (DD)

SEQ ID NO: 6289 - DNA, 561 bp, Artificial Sequence; identical to SEQ ID NO: 84
  Description of Artificial Sequence: Synthetic Destabilizing Domain (DD)

SEQ ID NO: 6290 - DNA, 561 bp, Artificial Sequence; identical to SEQ ID NO: 85
  Description of Artificial Sequence: Synthetic Destabilizing Domain (DD)

SEQ ID NO: 6291 - DNA, 558 bp, Artificial Sequence; identical to SEQ ID NO: 86
  Description of Artificial Sequence: Synthetic Destabilized Domain (DD)

SEQ ID NO: 6292 - DNA, 561 bp, Artificial Sequence; identical to SEQ ID NO: 74
  Description of Artificial Sequence: Synthetic Destabilizing Domain (DD)

SEQ ID NO: 6293 - DNA, 561 bp, Artificial Sequence; identical to SEQ ID NO: 80
  Description of Artificial Sequence: Synthetic Destabilizing Domain (DD)

SEQ ID NO: 6294 - DNA, 561 bp, Artificial Sequence; identical to SEQ ID NO: 78
  Description of Artificial Sequence: Synthetic Destabilizing Domain (DD)

SEQ ID NO: 6295 - DNA, 561 bp, Artificial Sequence; identical to SEQ ID NO: 81
  Description of Artificial Sequence: Synthetic Destabilizing Domain (DD)

SEQ ID NO: 6296 - DNA, 561 bp, Artificial Sequence; identical to SEQ ID NO: 90
  Description of Artificial Sequence: Synthetic Destabilizing Domain (DD)

SEQ ID NO: 6297 - DNA, 561 bp, Artificial Sequence; identical to SEQ ID NO: 91
  Description of Artificial Sequence: Synthetic Destabilizing Domain (DD)

SEQ ID NO: 6298 - DNA, 561 bp, Artificial Sequence; identical to SEQ ID NO: 92
  Description of Artificial Sequence: Synthetic Destabilizing Domain (DD)

SEQ ID NO: 6299 - DNA, 561 bp, Artificial Sequence; identical to SEQ ID NO: 93
  Description of Artificial Sequence: Synthetic Destabilizing Domain (DD)

SEQ ID NO: 6300 - DNA, 561 bp, Artificial Sequence; identical to SEQ ID NO: 94
  Description of Artificial Sequence: Synthetic Destabilizing Domain (DD)

SEQ ID NO: 6301 - DNA, 561 bp, Artificial Sequence; identical to SEQ ID NO: 95
  Description of Artificial Sequence: Synthetic Destabilizing Domain (DD)

SEQ ID NO: 6302 - DNA, 561 bp, Artificial Sequence; identical to SEQ ID NO: 96
  Description of Artificial Sequence: Synthetic Destabilizing Domain (DD)

SEQ ID NO: 6303 - DNA, 561 bp, Artificial Sequence; identical to SEQ ID NO: 97
  Description of Artificial Sequence: Synthetic Destabilizing Domain (DD)

SEQ ID NO: 6304 - DNA, 561 bp, Artificial Sequence; identical to SEQ ID NO: 98
  Description of Artificial Sequence: Synthetic Destabilizing Domain (DD)

SEQ ID NO: 6305 - DNA, 561 bp, Artificial Sequence; identical to SEQ ID NO: 99
  Description of Artificial Sequence: Synthetic Destabilizing Domain (DD)

SEQ ID NO: 6306 - DNA, 561 bp, Artificial Sequence; identical to SEQ ID NO: 100
  Description of Artificial Sequence: Synthetic Destabilizing Domain (DD)

SEQ ID NO: 6307 - DNA, 561 bp, Artificial Sequence; identical to SEQ ID NO: 101
  Description of Artificial Sequence: Synthetic Destabilizing Domain (DD)

SEQ ID NO: 6308 - DNA, 561 bp, Artificial Sequence; identical to SEQ ID NO: 102
  Description of Artificial Sequence: Synthetic Destabilizing Domain (DD)

SEQ ID NO: 6309 - DNA, 561 bp, Artificial Sequence; identical to SEQ ID NO: 103
  Description of Artificial Sequence: Synthetic Destabilizing Domain (DD)

SEQ ID NO: 6310 - DNA, 561 bp, Artificial Sequence; identical to SEQ ID NO: 104
  Description of Artificial Sequence: Synthetic Destabilizing Domain (DD)

SEQ ID NO: 6311 - DNA, 561 bp, Artificial Sequence; identical to SEQ ID NO: 105
  Description of Artificial Sequence: Synthetic Destabilizing Domain (DD)

SEQ ID NO: 6312 - DNA, 561 bp, Artificial Sequence; identical to SEQ ID NO: 106
  Description of Artificial Sequence: Synthetic Destabilizing Domain (DD)

SEQ ID NO: 6313 - DNA, 561 bp, Artificial Sequence; identical to SEQ ID NO: 107
  Description of Artificial Sequence: Synthetic Destabilizing Domain (DD)

SEQ ID NO: 6314 - DNA, 561 bp, Artificial Sequence; identical to SEQ ID NO: 108
  Description of Artificial Sequence: Synthetic Destabilizing Domain (DD)

SEQ ID NO: 6315 - DNA, 561 bp, Artificial Sequence; identical to SEQ ID NO: 109
  Description of Artificial Sequence: Synthetic Destabilizing Domain (DD)

SEQ ID NO: 6316 - DNA, 561 bp, Artificial Sequence; identical to SEQ ID NO: 110
  Description of Artificial Sequence: Synthetic Destabilizing Domain (DD)

SEQ ID NO: 6317 - DNA, 561 bp, Artificial Sequence; identical to SEQ ID NO: 111
  Description of Artificial Sequence: Synthetic Destabilizing Domain (DD)

SEQ ID NO: 6318 - DNA, 561 bp, Artificial Sequence; identical to SEQ ID NO: 112
  Description of Artificial Sequence: Synthetic Destabilizing Domain (DD)

SEQ ID NO: 6319 - DNA, 561 bp, Artificial Sequence; identical to SEQ ID NO: 113
  Description of Artificial Sequence: Synthetic Destabilizing Domain (DD)

SEQ ID NO: 6320 - DNA, 561 bp, Artificial Sequence; identical to SEQ ID NO: 114
  Description of Artificial Sequence: Synthetic Destabilizing Domain (DD)

SEQ ID NO: 6321 - DNA, 561 bp, Artificial Sequence; identical to SEQ ID NO: 115
  Description of Artificial Sequence: Synthetic Destabilizing Domain (DD)

SEQ ID NO: 6322 - DNA, 561 bp, Artificial Sequence; identical to SEQ ID NO: 116
  Description of Artificial Sequence: Synthetic Destabilizing Domain (DD)

SEQ ID NO: 6323 - DNA, 561 bp, Artificial Sequence; identical to SEQ ID NO: 117
  Description of Artificial Sequence: Synthetic Destabilizing Domain (DD)

SEQ ID NO: 6324 - DNA, 561 bp, Artificial Sequence; identical to SEQ ID NO: 118
  Description of Artificial Sequence: Synthetic Destabilizing Domain (DD)

SEQ ID NO: 6325 - DNA, 561 bp, Artificial Sequence; identical to SEQ ID NO: 119
  Description of Artificial Sequence: Synthetic Destabilizing Domain (DD)

SEQ ID NO: 6326 - DNA, 561 bp, Artificial Sequence; identical to SEQ ID NO: 120
  Description of Artificial Sequence: Synthetic Destabilizing Domain (DD)

SEQ ID NO: 6327 - DNA, 561 bp, Artificial Sequence; identical to SEQ ID NO: 121
  Description of Artificial Sequence: Synthetic Destabilizing Domain (DD)

SEQ ID NO: 6328 - DNA, 561 bp, Artificial Sequence; identical to SEQ ID NO: 122
  Description of Artificial Sequence: Synthetic Destabilizing Domain (DD)

SEQ ID NO: 6329 - DNA, 561 bp, Artificial Sequence; identical to SEQ ID NO: 123
  Description of Artificial Sequence: Synthetic Destabilizing Domain (DD)

SEQ ID NO: 6330 - DNA, 561 bp, Artificial Sequence; identical to SEQ ID NO: 124
  Description of Artificial Sequence: Synthetic Destabilizing Domain (DD)

SEQ ID NO: 6331 - DNA, 558 bp, Artificial Sequence; identical to SEQ ID NO: 125
  Description of Artificial Sequence: Synthetic Destabilizing Domain (DD)

SEQ ID NO: 6332 - DNA, 558 bp, Artificial Sequence; identical to SEQ ID NO: 126
  Description of Artificial Sequence: Synthetic Destabilizing Domain (DD)

SEQ ID NO: 6333 - DNA, 561 bp, Artificial Sequence; identical to SEQ ID NO: 1944
  Description of Artificial Sequence: Synthetic Destabilizing Domain (DD)

SEQ ID NO: 6334 - DNA, 561 bp, Artificial Sequence; identical to SEQ ID NO: 1944
  Description of Artificial Sequence: Synthetic Destabilizing Domain (DD)

SEQ ID NO: 6335 - DNA, 558 bp, Artificial Sequence; identical to SEQ ID NO: 1943
  Description of Artificial Sequence: Synthetic Destabilizing Domain (DD)

SEQ ID NO: 6336 - DNA, 561 bp, Artificial Sequence; identical to SEQ ID NO: 1688
  Description of Artificial Sequence: Synthetic Destabilizing Domain (DD)

SEQ ID NO: 6337 - DNA, 558 bp, Artificial Sequence; identical to SEQ ID NO: 1689
  Description of Artificial Sequence: Synthetic Destabilizing Domain (DD)

SEQ ID NO: 6338 - DNA, 558 bp, Artificial Sequence; identical to SEQ ID NO: 1690
  Description of Artificial Sequence: Synthetic Destabilizing Domain (DD)

SEQ ID NO: 6339 - DNA, 561 bp, Artificial Sequence; identical to SEQ ID NO: 1694
  Description of Artificial Sequence: Synthetic Destabilizing Domain (DD)

SEQ ID NO: 6340 - DNA, 558 bp, Artificial Sequence; identical to SEQ ID NO: 1695
  Description of Artificial Sequence: Synthetic Destabilizing Domain (DD)

SEQ ID NO: 6341 - DNA, 558 bp, Artificial Sequence; identical to SEQ ID NO: 1696
  Description of Artificial Sequence: Synthetic Destabilizing Domain (DD)

SEQ ID NO: 6342 - DNA, 558 bp, Artificial Sequence; identical to SEQ ID NO: 1946
  Description of Artificial Sequence: Synthetic Destabilizing Domain (DD)

SEQ ID NO: 6343 - DNA, 558 bp, Artificial Sequence; identical to SEQ ID NO: 1948
  Description of Artificial Sequence: Synthetic Destabilizing Domain (DD)

SEQ ID NO: 6344 - DNA, 558 bp, Artificial Sequence; identical to SEQ ID NO: 1820
  Description of Artificial Sequence: Synthetic Destabilizing Domain (DD)

SEQ ID NO: 6345 - DNA, 558 bp, Artificial Sequence; identical to SEQ ID NO: 1685
  Description of Artificial Sequence: Synthetic Destabilizing Domain (DD)

SEQ ID NO: 6346 - DNA, 558 bp, Artificial Sequence; identical to SEQ ID NO: 1686
  Description of Artificial Sequence: Synthetic Destabilizing Domain (DD)

SEQ ID NO: 6347 - DNA, 558 bp, Artificial Sequence; identical to SEQ ID NO: 1692
  Description of Artificial Sequence: Synthetic Destabilizing Domain (DD)

SEQ ID NO: 6348 - DNA, 807 bp, Artificial Sequence; identical to SEQ ID NO: 1792
  Description of Artificial Sequence: Synthetic Construct

SEQ ID NO: 6349 - DNA, 462 bp, Artificial Sequence; identical to SEQ ID NO: 1793
  Description of Artificial Sequence: Synthetic Construct

SEQ ID NO: 6350 - DNA, 960 bp, Artificial Sequence; identical to SEQ ID NO: 1794
  Description of Artificial Sequence: Synthetic Construct

SEQ ID NO: 6351 - DNA, 1587 bp, Artificial Sequence; identical to SEQ ID NO: 2294
  Description of Artificial Sequence: Synthetic Payload

SEQ ID NO: 6352 - DNA, 1740 bp, Artificial Sequence; identical to SEQ ID NO: 2295
  Description of Artificial Sequence: Synthetic Payload

SEQ ID NO: 6353 - DNA, 1824 bp, Artificial Sequence; identical to SEQ ID NO: 178
  Description of Artificial Sequence: Synthetic Payload

SEQ ID NO: 6354 - DNA, 1824 bp, Artificial Sequence; identical to SEQ ID NO: 179
  Description of Artificial Sequence: Synthetic Payload

SEQ ID NO: 6355 - DNA, 1824 bp, Artificial Sequence; identical to SEQ ID NO: 180
  Description of Artificial Sequence: Synthetic Payload

SEQ ID NO: 6356 - DNA, 1242 bp, Artificial Sequence; identical to SEQ ID NO: 2299
  Description of Artificial Sequence: Synthetic Payload

SEQ ID NO: 6357 - DNA, 1578 bp, Artificial Sequence; identical to SEQ ID NO: 2300
  Description of Artificial Sequence: Synthetic Payload

SEQ ID NO: 6358 - DNA, 1731 bp, Artificial Sequence; identical to SEQ ID NO: 2301
  Description of Artificial Sequence: Synthetic Payload

SEQ ID NO: 6359 - DNA, 1731 bp, Artificial Sequence; identical to SEQ ID NO: 2302
  Description of Artificial Sequence: Synthetic Payload

SEQ ID NO: 6360 - DNA, 1296 bp, Artificial Sequence; identical to SEQ ID NO: 2307
  Description of Artificial Sequence: Synthetic Construct

SEQ ID NO: 6361 - DNA, 1191 bp, Artificial Sequence; identical to SEQ ID NO: 2308
  Description of Artificial Sequence: Synthetic Construct

SEQ ID NO: 6362 - DNA, 1632 bp, Artificial Sequence; identical to SEQ ID NO: 2309
  Description of Artificial Sequence: Synthetic Construct

SEQ ID NO: 6363 - DNA, 1785 bp, Artificial Sequence; identical to SEQ ID NO: 2310
  Description of Artificial Sequence: Synthetic Construct

SEQ ID NO: 6364 - DNA, 1623 bp, Artificial Sequence; identical to SEQ ID NO: 2311
  Description of Artificial Sequence: Synthetic Construct

SEQ ID NO: 6365 - DNA, 1776 bp, Artificial Sequence; identical to SEQ ID NO: 2312
  Description of Artificial Sequence: Synthetic Construct

SEQ ID NO: 6366 - DNA, 1518 bp, Artificial Sequence; identical to SEQ ID NO: 2313
  Description of Artificial Sequence: Synthetic Construct

SEQ ID NO: 6367 - DNA, 1671 bp, Artificial Sequence; identical to SEQ ID NO: 2314
  Description of Artificial Sequence: Synthetic Construct

SEQ ID NO: 6368 - DNA, 1518 bp, Artificial Sequence; identical to SEQ ID NO: 2315
  Description of Artificial Sequence: Synthetic Construct

SEQ ID NO: 6369 - DNA, 1671 bp, Artificial Sequence; identical to SEQ ID NO: 2316
  Description of Artificial Sequence: Synthetic Construct

SEQ ID NO: 6370 - DNA, 1473 bp, Artificial Sequence; identical to SEQ ID NO: 1772
  Description of Artificial Sequence: Synthetic Construct

SEQ ID NO: 6371 - DNA, 1800 bp, Artificial Sequence; identical to SEQ ID NO: 1773
  Description of Artificial Sequence: Synthetic Construct

SEQ ID NO: 6372 - DNA, 1953 bp, Artificial Sequence; identical to SEQ ID NO: 1774
  Description of Artificial Sequence: Synthetic Construct

SEQ ID NO: 6373 - protein, 311 aa, Renilla reniformis; identical to SEQ ID NO: 2698

SEQ ID NO: 6374 - DNA, 936 bp, Renilla reniformis; identical to SEQ ID NO: 2685

SEQ ID NO: 6375 - protein, 550 aa, Photinus pyralis; identical to SEQ ID NO: 2700

SEQ ID NO: 6376 - DNA, 1653 bp, Photinus pyralis; identical to SEQ ID NO: 2701

SEQ ID NO: 6377 - DNA, 936 bp, Renilla reniformis; identical to SEQ ID NO: 2685

SEQ ID NO: 6378 - DNA, 1653 bp, Photinus pyralis; identical to SEQ ID NO: 2701

SEQ ID NO: 6379 - DNA, 321 bp, Artificial Sequence; identical to SEQ ID NO: 1786
  Description of Artificial Sequence: Synthetic Destabilized Domain (DD)

SEQ ID NO: 6380 - DNA, 321 bp, Artificial Sequence; identical to SEQ ID NO: 1664
  Description of Artificial Sequence: Synthetic Destabilizing Domain (DD)

SEQ ID NO: 6381 - DNA, 321 bp, Artificial Sequence; identical to SEQ ID NO: 1665
  Description of Artificial Sequence: Synthetic Destabilizing Domain (DD)

SEQ ID NO: 6382 - DNA, 321 bp, Artificial Sequence; identical to SEQ ID NO: 1666
  Description of Artificial Sequence: Synthetic Destabilizing Domain (DD)

SEQ ID NO: 6383 - DNA, 321 bp, Artificial Sequence; identical to SEQ ID NO: 1667
  Description of Artificial Sequence: Synthetic Destabilizing Domain (DD)

SEQ ID NO: 6384 - DNA, 321 bp, Artificial Sequence; identical to SEQ ID NO: 1668
  Description of Artificial Sequence: Synthetic Destabilizing Domain (DD)

SEQ ID NO: 6385 - DNA, 321 bp, Artificial Sequence; identical to SEQ ID NO: 1764
  Description of Artificial Sequence: Synthetic Destabilizing Domain (DD)

SEQ ID NO: 6386 - DNA, 324 bp, Artificial Sequence; identical to SEQ ID NO: 1669
  Description of Artificial Sequence: Synthetic Destabilizing Domain (DD)

SEQ ID NO: 6387 - DNA, 324 bp, Artificial Sequence; identical to SEQ ID NO: 1670
  Description of Artificial Sequence: Synthetic Destabilizing Domain (DD)

SEQ ID NO: 6388 - DNA, 324 bp, Artificial Sequence; identical to SEQ ID NO: 1671
  Description of Artificial Sequence: Synthetic Destabilizing Domain (DD)

SEQ ID NO: 6389 - DNA, 324 bp, Artificial Sequence; identical to SEQ ID NO: 1672
  Description of Artificial Sequence: Synthetic Destabilizing Domain (DD)

SEQ ID NO: 6390 - DNA, 321 bp, Artificial Sequence; identical to SEQ ID NO: 1673
  Description of Artificial Sequence: Synthetic Destabilizing Domain (DD)

SEQ ID NO: 6391 - DNA, 321 bp, Artificial Sequence; identical to SEQ ID NO: 1674
  Description of Artificial Sequence: Synthetic Destabilizing Domain (DD)

SEQ ID NO: 6392 - DNA, 321 bp, Artificial Sequence; identical to SEQ ID NO: 1675
  Description of Artificial Sequence: Synthetic Destabilizing Domain (DD)

SEQ ID NO: 6393 - DNA, 477 bp, Artificial Sequence; identical to SEQ ID NO: 5683
  Description of Artificial Sequence: Synthetic Destabilizing Domain (DD)

SEQ ID NO: 6394 - DNA, 936 bp, Artificial Sequence; identical to SEQ ID NO: 2685
  Description of Artificial Sequence: Synthetic Construct

SEQ ID NO: 6395 - DNA, 1983 bp, Artificial Sequence; identical to SEQ ID NO: 2686
  Description of Artificial Sequence: Synthetic Construct

SEQ ID NO: 6396 - DNA, 1263 bp, Artificial Sequence; identical to SEQ ID NO: 2687
  Description of Artificial Sequence: Synthetic Construct

SEQ ID NO: 6397 - DNA, 1416 bp, Artificial Sequence; identical to SEQ ID NO: 2688
  Description of Artificial Sequence: Synthetic Construct

SEQ ID NO: 6398 - DNA, 1263 bp, Artificial Sequence; identical to SEQ ID NO: 2689
  Description of Artificial Sequence: Synthetic Construct

SEQ ID NO: 6399 - DNA, 1416 bp, Artificial Sequence; identical to SEQ ID NO: 2727
  Description of Artificial Sequence: Synthetic Construct

SEQ ID NO: 6400 - DNA, 603 bp, Artificial Sequence; identical to SEQ ID NO: 1795
  Description of Artificial Sequence: Synthetic Promoter

SEQ ID NO: 6401 - DNA, 1339 bp, Artificial Sequence; identical to SEQ ID NO: 1796
  Description of Artificial Sequence: Synthetic Promoter

SEQ ID NO: 6402 - DNA, 399 bp, Artificial Sequence; identical to SEQ ID NO: 1797
  Description of Artificial Sequence: Synthetic Promoter

SEQ ID NO: 6403 - DNA, 603 bp, Artificial Sequence; identical to SEQ ID NO: 1795
  Description of Artificial Sequence: Synthetic promoter

SEQ ID NO: 6404 - DNA, 1339 bp, Artificial Sequence; identical to SEQ ID NO: 1796
  Description of Artificial Sequence: Synthetic promoter

SEQ ID NO: 6405 - DNA, 399 bp, Artificial Sequence; identical to SEQ ID NO: 1797
  Description of Artificial Sequence: Synthetic promoter

SEQ ID NO: 6406 - DNA, 1335 bp, Artificial Sequence; identical to SEQ ID NO: 1798
  Description of Artificial Sequence: Synthetic promoter

SEQ ID NO: 6407 - DNA, 603 bp, Artificial Sequence; identical to SEQ ID NO: 1795
  Description of Artificial Sequence: Synthetic Promoter

SEQ ID NO: 6408 - DNA, 1339 bp, Artificial Sequence; identical to SEQ ID NO: 1796
  Description of Artificial Sequence: Synthetic Promoter

SEQ ID NO: 6409 - DNA, 399 bp, Artificial Sequence; identical to SEQ ID NO: 1797
  Description of Artificial Sequence: Synthetic Promoter

SEQ ID NO: 6410 - DNA, 1335 bp, Artificial Sequence; identical to SEQ ID NO: 1798
  Description of Artificial Sequence: Synthetic Promoter

SEQ ID NO: 6411 - DNA, 21 bp, Artificial Sequence
  Description of Artificial Sequence: Synthetic Forward Primer
gaattcctcgaggccaccatg

SEQ ID NO: 6412 - DNA, 20 bp, Artificial Sequence
  Description of Artificial Sequence: Synthetic Reverse Primer
ccaccagagccaccactagt

SEQ ID NO: 6413 - protein, 6 aa, Artificial Sequence
  Description of Artificial Sequence: Synthetic Linker
GGSGGG

SEQ ID NO: 6414 - protein, 239 aa, Artificial Sequence; identical to SEQ ID NO: 1181
  Description of Artificial Sequence: Synthetic polypeptide

SEQ ID NO: 6415 - protein, 187 aa, Artificial Sequence; identical to SEQ ID NO: 2
  Description of Artificial Sequence: Synthetic Destabilizing Domain (DD)

SEQ ID NO: 6416 - protein, 187 aa, Artificial Sequence; identical to SEQ ID NO: 3
  Description of Artificial Sequence: Synthetic Destabilizing Domain (DD)

SEQ ID NO: 6417 - protein, 187 aa, Artificial Sequence; identical to SEQ ID NO: 4
  Description of Artificial Sequence: Synthetic Destabilizing Domain (DD)

SEQ ID NO: 6418 - protein, 187 aa, Artificial Sequence; identical to SEQ ID NO: 5
  Description of Artificial Sequence: Synthetic Destabilizing Domain (DD)

SEQ ID NO: 6419 - protein, 187 aa, Artificial Sequence; identical to SEQ ID NO: 6
  Description of Artificial Sequence: Synthetic Destabilizing Domain (DD)

SEQ ID NO: 6420 - protein, 187 aa, Artificial Sequence; identical to SEQ ID NO: 7
  Description of Artificial Sequence: Synthetic Destabilizing Domain (DD)

SEQ ID NO: 6421 - protein, 187 aa, Artificial Sequence; identical to SEQ ID NO: 8
  Description of Artificial Sequence: Synthetic Destabilizing Domain (DD)

SEQ ID NO: 6422 - protein, 187 aa, Artificial Sequence; identical to SEQ ID NO: 9
  Description of Artificial Sequence: Synthetic Destabilizing Domain (DD)

SEQ ID NO: 6423 - protein, 187 aa, Artificial Sequence; identical to SEQ ID NO: 10
  Description of Artificial Sequence: Synthetic Destabilizing Domain (DD)

SEQ ID NO: 6424 - protein, 187 aa, Artificial Sequence; identical to SEQ ID NO: 11
  Description of Artificial Sequence: Synthetic Destabilizing Domain (DD)

SEQ ID NO: 6425 - protein, 187 aa, Artificial Sequence; identical to SEQ ID NO: 12
  Description of Artificial Sequence: Synthetic Destabilizing Domain (DD)

SEQ ID NO: 6426 - protein, 186 aa, Artificial Sequence; identical to SEQ ID NO: 13
  Description of Artificial Sequence: Synthetic Destabilizing Domain (DD)

SEQ ID NO: 6427 - protein, 187 aa, Artificial Sequence; identical to SEQ ID NO: 14
  Description of Artificial Sequence: Synthetic Destabilizing Domain (DD)

SEQ ID NO: 6428 - protein, 187 aa, Artificial Sequence; identical to SEQ ID NO: 15
  Description of Artificial Sequence: Synthetic Destabilizing Domain (DD)

SEQ ID NO: 6429 - protein, 187 aa, Artificial Sequence; identical to SEQ ID NO: 16
  Description of Artificial Sequence: Synthetic Destabilizing Domain (DD)

SEQ ID NO: 6430 - protein, 187 aa, Artificial Sequence; identical to SEQ ID NO: 17
  Description of Artificial Sequence: Synthetic Destabilizing Domain (DD)

SEQ ID NO: 6431 - protein, 187 aa, Artificial Sequence; identical to SEQ ID NO: 18
  Description of Artificial Sequence: Synthetic Destabilizing Domain (DD)

SEQ ID NO: 6432 - protein, 187 aa, Artificial Sequence; identical to SEQ ID NO: 19
  Description of Artificial Sequence: Synthetic Destabilizing Domain (DD)

SEQ ID NO: 6433 - protein, 187 aa, Artificial Sequence; identical to SEQ ID NO: 20
  Description of Artificial Sequence: Synthetic Destabilizing Domain (DD)

SEQ ID NO: 6434 - protein, 187 aa, Artificial Sequence; identical to SEQ ID NO: 21
  Description of Artificial Sequence: Synthetic Destabilizing Domain (DD)

SEQ ID NO: 6435 - protein, 187 aa, Artificial Sequence; identical to SEQ ID NO: 22
  Description of Artificial Sequence: Synthetic Destabilizing Domain (DD)

SEQ ID NO: 6436 - protein, 187 aa, Artificial Sequence; identical to SEQ ID NO: 23
  Description of Artificial Sequence: Synthetic Destabilizing Domain (DD)

SEQ ID NO: 6437 - protein, 187 aa, Artificial Sequence; identical to SEQ ID NO: 24
  Description of Artificial Sequence: Synthetic Destabilizing Domain (DD)

SEQ ID NO: 6438 - protein, 187 aa, Artificial Sequence; identical to SEQ ID NO: 25
  Description of Artificial Sequence: Synthetic Destabilizing Domain (DD)

SEQ ID NO: 6439 - protein, 187 aa, Artificial Sequence; identical to SEQ ID NO: 26
  Description of Artificial Sequence: Synthetic Destabilizing Domain (DD)

SEQ ID NO: 6440 - protein, 187 aa, Artificial Sequence; identical to SEQ ID NO: 27
  Description of Artificial Sequence: Synthetic Destabilizing Domain (DD)

SEQ ID NO: 6441 - protein, 187 aa, Artificial Sequence; identical to SEQ ID NO: 28
  Description of Artificial Sequence: Synthetic Destabilizing Domain (DD)

SEQ ID NO: 6442 - protein, 187 aa, Artificial Sequence; identical to SEQ ID NO: 29
  Description of Artificial Sequence: Synthetic Destabilizing Domain (DD)

SEQ ID NO: 6443 - protein, 187 aa, Artificial Sequence; identical to SEQ ID NO: 30
  Description of Artificial Sequence: Synthetic Destabilizing Domain (DD)

SEQ ID NO: 6444 - protein, 187 aa, Artificial Sequence; identical to SEQ ID NO: 31
  Description of Artificial Sequence: Synthetic Destabilizing Domain (DD)

SEQ ID NO: 6445 - protein, 186 aa, Artificial Sequence; identical to SEQ ID NO: 32
  Description of Artificial Sequence: Synthetic Destabilizing Domain (DD)

SEQ ID NO: 6446 - protein, 186 aa, Artificial Sequence; identical to SEQ ID NO: 33
  Description of Artificial Sequence: Synthetic Destabilizing Domain (DD)

SEQ ID NO: 6447 - protein, 186 aa, Artificial Sequence; identical to SEQ ID NO: 34
  Description of Artificial Sequence: Synthetic Destabilizing Domain (DD)

SEQ ID NO: 6448 - protein, 186 aa, Artificial Sequence; identical to SEQ ID NO: 35
  Description of Artificial Sequence: Synthetic Destabilizing Domain (DD)

SEQ ID NO: 6449 - protein, 186 aa, Artificial Sequence; identical to SEQ ID NO: 36
  Description of Artificial Sequence: Synthetic Destabilizing Domain (DD)

SEQ ID NO: 6450 - protein, 186 aa, Artificial Sequence; identical to SEQ ID NO: 37
  Description of Artificial Sequence: Synthetic Destabilizing Domain (DD)

SEQ ID NO: 6451 - protein, 186 aa, Artificial Sequence; identical to SEQ ID NO: 38
  Description of Artificial Sequence: Synthetic Destabilizing Domain (DD)

SEQ ID NO: 6452 - protein, 186 aa, Artificial Sequence; identical to SEQ ID NO: 39
  Description of Artificial Sequence: Synthetic Destabilizing Domain (DD)

SEQ ID NO: 6453 - protein, 186 aa, Artificial Sequence; identical to SEQ ID NO: 40
  Description of Artificial Sequence: Synthetic Destabilizing Domain (DD)

SEQ ID NO: 6454 - protein, 186 aa, Artificial Sequence; identical to SEQ ID NO: 41
  Description of Artificial Sequence: Synthetic Destabilizing Domain (DD)

SEQ ID NO: 6455 - protein, 186 aa, Artificial Sequence; identical to SEQ ID NO: 42
  Description of Artificial Sequence: Synthetic Destabilizing Domain (DD)

SEQ ID NO: 6456 - protein, 187 aa, Artificial Sequence; identical to SEQ ID NO: 43
  Description of Artificial Sequence: Synthetic Destabilizing Domain (DD)

SEQ ID NO: 6457 - protein, 187 aa, Artificial Sequence; identical to SEQ ID NO: 44
  Description of Artificial Sequence: Synthetic Destabilizing Domain (DD)

SEQ ID NO: 6458 - protein, 187 aa, Artificial Sequence; identical to SEQ ID NO: 45
  Description of Artificial Sequence: Synthetic Destabilizing Domain (DD)

SEQ ID NO: 6459 - protein, 187 aa, Artificial Sequence; identical to SEQ ID NO: 46
  Description of Artificial Sequence: Synthetic Destabilizing Domain (DD)

SEQ ID NO: 6460 - protein, 187 aa, Artificial Sequence; identical to SEQ ID NO: 47
  Description of Artificial Sequence: Synthetic Destabilizing Domain (DD)

SEQ ID NO: 6461 - protein, 187 aa, Artificial Sequence; identical to SEQ ID NO: 48
  Description of Artificial Sequence: Synthetic Destabilizing Domain (DD)

SEQ ID NO: 6462 - protein, 187 aa, Artificial Sequence; identical to SEQ ID NO: 49
  Description of Artificial Sequence: Synthetic Destabilizing Domain (DD)

SEQ ID NO: 6463 - protein, 187 aa, Artificial Sequence; identical to SEQ ID NO: 50
  Description of Artificial Sequence: Synthetic Destabilizing Domain (DD)

SEQ ID NO: 6464 - protein, 187 aa, Artificial Sequence; identical to SEQ ID NO: 51
  Description of Artificial Sequence: Synthetic Destabilizing Domain (DD)

SEQ ID NO: 6465 - protein, 187 aa, Artificial Sequence; identical to SEQ ID NO: 52
  Description of Artificial Sequence: Synthetic Destabilizing Domain (DD)

SEQ ID NO: 6466 - protein, 187 aa, Artificial Sequence; identical to SEQ ID NO: 53
  Description of Artificial Sequence: Synthetic Destabilizing Domain (DD)

SEQ ID NO: 6467 - protein, 187 aa, Artificial Sequence; identical to SEQ ID NO: 54
  Description of Artificial Sequence: Synthetic Destabilizing Domain (DD)

SEQ ID NO: 6468 - protein, 186 aa, Artificial Sequence; identical to SEQ ID NO: 55
  Description of Artificial Sequence: Synthetic Destabilizing Domain (DD)

SEQ ID NO: 6469 - protein, 186 aa, Artificial Sequence; identical to SEQ ID NO: 56
  Description of Artificial Sequence: Synthetic Destabilizing Domain (DD)

SEQ ID NO: 6470 - protein, 186 aa, Artificial Sequence; identical to SEQ ID NO: 57
  Description of Artificial Sequence: Synthetic Destabilizing Domain (DD)

SEQ ID NO: 6471 - protein, 186 aa, Artificial Sequence; identical to SEQ ID NO: 1196
  Description of Artificial Sequence: Synthetic Destabilizing Domain (DD)

SEQ ID NO: 6472 - protein, 187 aa, Artificial Sequence; identical to SEQ ID NO: 59
  Description of Artificial Sequence: Synthetic Destabilizing Domain (DD)

SEQ ID NO: 6473 - protein, 187 aa, Artificial Sequence; identical to SEQ ID NO: 60
  Description of Artificial Sequence: Synthetic Destabilizing Domain (DD)

SEQ ID NO: 6474 - protein, 186 aa, Artificial Sequence; identical to SEQ ID NO: 61
  Description of Artificial Sequence: Synthetic Destabilizing Domain (DD)

SEQ ID NO: 6475 - protein, 187 aa, Artificial Sequence; identical to SEQ ID NO: 62
  Description of Artificial Sequence: Synthetic Destabilizing Domain (DD)

SEQ ID NO: 6476 - protein, 187 aa, Artificial Sequence; identical to SEQ ID NO: 63
  Description of Artificial Sequence: Synthetic Destabilizing Domain (DD)

SEQ ID NO: 6477 - protein, 187 aa, Artificial Sequence; identical to SEQ ID NO: 64
  Description of Artificial Sequence: Synthetic Destabilizing Domain (DD)

SEQ ID NO: 6478 - protein, 187 aa, Artificial Sequence; identical to SEQ ID NO: 65
  Description of Artificial Sequence: Synthetic Destabilizing Domain (DD)

SEQ ID NO: 6479 - protein, 187 aa, Artificial Sequence; identical to SEQ ID NO: 66
  Description of Artificial Sequence: Synthetic Destabilizing Domain (DD)

SEQ ID NO: 6480 - protein, 187 aa, Artificial Sequence; identical to SEQ ID NO: 67
  Description of Artificial Sequence: Synthetic Destabilizing Domain (DD)

SEQ ID NO: 6481 - protein, 187 aa, Artificial Sequence; identical to SEQ ID NO: 68
  Description of Artificial Sequence: Synthetic Destabilizing Domain (DD)

SEQ ID NO: 6482 - protein, 187 aa, Artificial Sequence; identical to SEQ ID NO: 69
  Description of Artificial Sequence: Synthetic Destabilizing Domain (DD)

SEQ ID NO: 6483 - protein, 187 aa, Artificial Sequence; identical to SEQ ID NO: 70
  Description of Artificial Sequence: Synthetic Destabilizing Domain (DD)

SEQ ID NO: 6484 - protein, 186 aa, Artificial Sequence; identical to SEQ ID NO: 71
  Description of Artificial Sequence: Synthetic Destabilizing Domain (DD)

SEQ ID NO: 6485 - DNA, 561 bp, Artificial Sequence; identical to SEQ ID NO: 72
  Description of Artificial Sequence: Synthetic Destabilizing Domain (DD)

SEQ ID NO: 6486 - DNA, 561 bp, Artificial Sequence; identical to SEQ ID NO: 73
  Description of Artificial Sequence: Synthetic Destabilizing Domain (DD)

SEQ ID NO: 6487 - DNA, 561 bp, Artificial Sequence; identical to SEQ ID NO: 74
  Description of Artificial Sequence: Synthetic Destabilizing Domain (DD)

SEQ ID NO: 6488 - DNA, 561 bp, Artificial Sequence; identical to SEQ ID NO: 75
  Description of Artificial Sequence: Synthetic Destabilizing Domain (DD)

SEQ ID NO: 6489 - DNA, 561 bp, Artificial Sequence; identical to SEQ ID NO: 76
  Description of Artificial Sequence: Synthetic Destabilizing Domain (DD)

SEQ ID NO: 6490 - DNA, 561 bp, Artificial Sequence; identical to SEQ ID NO: 77
  Description of Artificial Sequence: Synthetic Destabilizing Domain (DD)

SEQ ID NO: 6491 - DNA, 561 bp, Artificial Sequence; identical to SEQ ID NO: 78
  Description of Artificial Sequence: Synthetic Destabilizing Domain (DD)

SEQ ID NO: 6492 - DNA, 561 bp, Artificial Sequence; identical to SEQ ID NO: 79
  Description of Artificial Sequence: Synthetic Destabilizing Domain (DD)

SEQ ID NO: 6493 - DNA, 561 bp, Artificial Sequence; identical to SEQ ID NO: 80
  Description of Artificial Sequence: Synthetic Destabilizing Domain (DD)

SEQ ID NO: 6494 - DNA, 561 bp, Artificial Sequence; identical to SEQ ID NO: 81
  Description of Artificial Sequence: Synthetic Destabilizing Domain (DD)

SEQ ID NO: 6495 - DNA, 561 bp, Artificial Sequence; identical to SEQ ID NO: 82
  Description of Artificial Sequence: Synthetic Destabilizing Domain (DD)

SEQ ID NO: 6496 - DNA, 561 bp, Artificial Sequence; identical to SEQ ID NO: 83
  Description of Artificial Sequence: Synthetic Destabilizing Domain (DD)

SEQ ID NO: 6497 - DNA, 561 bp, Artificial Sequence; identical to SEQ ID NO: 84
  Description of Artificial Sequence: Synthetic Destabilizing Domain (DD)

SEQ ID NO: 6498 - DNA, 561 bp, Artificial Sequence; identical to SEQ ID NO: 85
  Description of Artificial Sequence: Synthetic Destabilizing Domain (DD)

SEQ ID NO: 6499 - DNA, 558 bp, Artificial Sequence; identical to SEQ ID NO: 86
  Description of Artificial Sequence: Synthetic Destabilizing Domain (DD)

SEQ ID NO: 6500 - DNA, 558 bp, Artificial Sequence; identical to SEQ ID NO: 87
  Description of Artificial Sequence: Synthetic Destabilizing Domain (DD)

SEQ ID NO: 6501 - DNA, 558 bp, Artificial Sequence; identical to SEQ ID NO: 88
  Description of Artificial Sequence: Synthetic Destabilizing Domain (DD)

SEQ ID NO: 6502 - DNA, 558 bp, Artificial Sequence; identical to SEQ ID NO: 89
  Description of Artificial Sequence: Synthetic Destabilizing Domain (DD)

SEQ ID NO: 6503 - DNA, 561 bp, Artificial Sequence; identical to SEQ ID NO: 90
  Description of Artificial Sequence: Synthetic Destabilizing Domain (DD)

SEQ ID NO: 6504 - DNA, 561 bp, Artificial Sequence; identical to SEQ ID NO: 91
  Description of Artificial Sequence: Synthetic Destabilizing Domain (DD)

SEQ ID NO: 6505 - DNA, 561 bp, Artificial Sequence; identical to SEQ ID NO: 92
  Description of Artificial Sequence: Synthetic Destabilizing Domain (DD)

SEQ ID NO: 6506 - DNA, 561 bp, Artificial Sequence; identical to SEQ ID NO: 93
  Description of Artificial Sequence: Synthetic Destabilizing Domain (DD)

SEQ ID NO: 6507 - DNA, 561 bp, Artificial Sequence; identical to SEQ ID NO: 94
  Description of Artificial Sequence: Synthetic Destabilizing Domain (DD)

SEQ ID NO: 6508 - DNA, 561 bp, Artificial Sequence; identical to SEQ ID NO: 95
  Description of Artificial Sequence: Synthetic Destabilizing Domain (DD)

SEQ ID NO: 6509 - DNA, 561 bp, Artificial Sequence; identical to SEQ ID NO: 96
  Description of Artificial Sequence: Synthetic Destabilizing Domain (DD)

SEQ ID NO: 6510 - DNA, 561 bp, Artificial Sequence; identical to SEQ ID NO: 97
  Description of Artificial Sequence: Synthetic Destabilizing Domain (DD)

SEQ ID NO: 6511 - DNA, 561 bp, Artificial Sequence; identical to SEQ ID NO: 98
  Description of Artificial Sequence: Synthetic Destabilizing Domain (DD)

SEQ ID NO: 6512 - DNA, 561 bp, Artificial Sequence; identical to SEQ ID NO: 99
  Description of Artificial Sequence: Synthetic Destabilizing Domain (DD)

SEQ ID NO: 6513 - DNA, 561 bp, Artificial Sequence; identical to SEQ ID NO: 100
  Description of Artificial Sequence: Synthetic Destabilizing Domain (DD)

SEQ ID NO: 6514 - DNA, 561 bp, Artificial Sequence; identical to SEQ ID NO: 101
  Description of Artificial Sequence: Synthetic Destabilizing Domain (DD)

SEQ ID NO: 6515 - DNA, 561 bp, Artificial Sequence; identical to SEQ ID NO: 102
  Description of Artificial Sequence: Synthetic Destabilizing Domain (DD)

SEQ ID NO: 6516 - DNA, 561 bp, Artificial Sequence; identical to SEQ ID NO: 103
  Description of Artificial Sequence: Synthetic Destabilizing Domain (DD)

SEQ ID NO: 6517 - DNA, 561 bp, Artificial Sequence; identical to SEQ ID NO: 104
  Description of Artificial Sequence: Synthetic Destabilizing Domain (DD)

SEQ ID NO: 6518 - DNA, 561 bp, Artificial Sequence; identical to SEQ ID NO: 105
  Description of Artificial Sequence: Synthetic Destabilizing Domain (DD)

SEQ ID NO: 6519 - DNA, 561 bp, Artificial Sequence; identical to SEQ ID NO: 106
  Description of Artificial Sequence: Synthetic Destabilizing Domain (DD)

SEQ ID NO: 6520 - DNA, 561 bp, Artificial Sequence; identical to SEQ ID NO: 107
  Description of Artificial Sequence: Synthetic Destabilizing Domain (DD)

SEQ ID NO: 6521 - DNA, 561 bp, Artificial Sequence; identical to SEQ ID NO: 108
  Description of Artificial Sequence: Synthetic Destabilizing Domain (DD)

SEQ ID NO: 6522 - DNA, 561 bp, Artificial Sequence; identical to SEQ ID NO: 109
  Description of Artificial Sequence: Synthetic Destabilizing Domain (DD)

SEQ ID NO: 6523 - DNA, 561 bp, Artificial Sequence; identical to SEQ ID NO: 110
  Description of Artificial Sequence: Synthetic Destabilizing Domain (DD)

SEQ ID NO: 6524 - DNA, 561 bp, Artificial Sequence; identical to SEQ ID NO: 111
  Description of Artificial Sequence: Synthetic Destabilizing Domain (DD)

SEQ ID NO: 6525 - DNA, 561 bp, Artificial Sequence; identical to SEQ ID NO: 112
  Description of Artificial Sequence: Synthetic Destabilizing Domain (DD)

SEQ ID NO: 6526 - DNA, 561 bp, Artificial Sequence; identical to SEQ ID NO: 113
  Description of Artificial Sequence: Synthetic Destabilizing Domain (DD)

SEQ ID NO: 6527 - DNA, 561 bp, Artificial Sequence; identical to SEQ ID NO: 114
  Description of Artificial Sequence: Synthetic Destabilizing Domain (DD)

SEQ ID NO: 6528 - DNA, 561 bp, Artificial Sequence; identical to SEQ ID NO: 115
  Description of Artificial Sequence: Synthetic Destabilizing Domain (DD)

SEQ ID NO: 6529 - DNA, 561 bp, Artificial Sequence; identical to SEQ ID NO: 116
  Description of Artificial Sequence: Synthetic Destabilizing Domain (DD)

SEQ ID NO: 6530 - DNA, 561 bp, Artificial Sequence; identical to SEQ ID NO: 117
  Description of Artificial Sequence: Synthetic Destabilizing Domain (DD)

SEQ ID NO: 6531 - DNA, 561 bp, Artificial Sequence; identical to SEQ ID NO: 118
  Description of Artificial Sequence: Synthetic Destabilizing Domain (DD)

SEQ ID NO: 6532 - DNA, 561 bp, Artificial Sequence; identical to SEQ ID NO: 119
  Description of Artificial Sequence: Synthetic Destabilizing Domain (DD)

SEQ ID NO: 6533 - DNA, 561 bp, Artificial Sequence; identical to SEQ ID NO: 120
  Description of Artificial Sequence: Synthetic Destabilizing Domain (DD)

SEQ ID NO: 6534 - DNA, 561 bp, Artificial Sequence; identical to SEQ ID NO: 121
  Description of Artificial Sequence: Synthetic Destabilizing Domain (DD)

SEQ ID NO: 6535 - DNA, 561 bp, Artificial Sequence; identical to SEQ ID NO: 122
  Description of Artificial Sequence: Synthetic Destabilizing Domain (DD)

SEQ ID NO: 6536 - DNA, 561 bp, Artificial Sequence; identical to SEQ ID NO: 123
  Description of Artificial Sequence: Synthetic Destabilizing Domain (DD)

SEQ ID NO: 6537 - DNA, 561 bp, Artificial Sequence; identical to SEQ ID NO: 124
  Description of Artificial Sequence: Synthetic Destabilizing Domain (DD)

SEQ ID NO: 6538 - DNA, 558 bp, Artificial Sequence; identical to SEQ ID NO: 125
  Description of Artificial Sequence: Synthetic Destabilizing Domain (DD)

SEQ ID NO: 6539 - DNA, 558 bp, Artificial Sequence; identical to SEQ ID NO: 126
  Description of Artificial Sequence: Synthetic Destabilizing Domain (DD)

SEQ ID NO: 6540 - DNA, 558 bp, Artificial Sequence; identical to SEQ ID NO: 127
  Description of Artificial Sequence: Synthetic Destabilizing Domain (DD)

SEQ ID NO: 6541 - DNA, 558 bp, Artificial Sequence; identical to SEQ ID NO: 128
  Description of Artificial Sequence: Synthetic Destabilizing Domain (DD)

SEQ ID NO: 6542 - DNA, 558 bp, Artificial Sequence; identical to SEQ ID NO: 129
  Description of Artificial Sequence: Synthetic Destabilizing Domain (DD)

SEQ ID NO: 6543 - DNA, 558 bp, Artificial Sequence; identical to SEQ ID NO: 130
  Description of Artificial Sequence: Synthetic Destabilizing Domain (DD)

SEQ ID NO: 6544 - DNA, 558 bp, Artificial Sequence; identical to SEQ ID NO: 131
  Description of Artificial Sequence: Synthetic Destabilizing Domain (DD)

SEQ ID NO: 6545 - DNA, 558 bp, Artificial Sequence; identical to SEQ ID NO: 132
  Description of Artificial Sequence: Synthetic Destabilizing Domain (DD)

SEQ ID NO: 6546 - DNA, 558 bp, Artificial Sequence; identical to SEQ ID NO: 133
  Description of Artificial Sequence: Synthetic Destabilizing Domain (DD)

SEQ ID NO: 6547 - DNA, 558 bp, Artificial Sequence; identical to SEQ ID NO: 134
  Description of Artificial Sequence: Synthetic Destabilizing Domain (DD)

SEQ ID NO: 6548 - DNA, 561 bp, Artificial Sequence; identical to SEQ ID NO: 135
  Description of Artificial Sequence: Synthetic Destabilizing Domain (DD)

SEQ ID NO: 6549 - DNA, 561 bp, Artificial Sequence; identical to SEQ ID NO: 136
  Description of Artificial Sequence: Synthetic Destabilizing Domain (DD)

SEQ ID NO: 6550 - DNA, 561 bp, Artificial Sequence; identical to SEQ ID NO: 137
  Description of Artificial Sequence: Synthetic Destabilizing Domain (DD)

SEQ ID NO: 6551 - DNA, 561 bp, Artificial Sequence; identical to SEQ ID NO: 138
  Description of Artificial Sequence: Synthetic Destabilizing Domain (DD)

SEQ ID NO: 6552 - DNA, 561 bp, Artificial Sequence; identical to SEQ ID NO: 139
  Description of Artificial Sequence: Synthetic Destabilizing Domain (DD)

SEQ ID NO: 6553 - DNA, 561 bp, Artificial Sequence; identical to SEQ ID NO: 140
  Description of Artificial Sequence: Synthetic Destabilizing Domain (DD)

SEQ ID NO: 6554 - DNA, 561 bp, Artificial Sequence; identical to SEQ ID NO: 141
  Description of Artificial Sequence: Synthetic Destabilizing Domain (DD)

SEQ ID NO: 6555 - protein, 187 aa, Artificial Sequence; identical to SEQ ID NO: 2
  Description of Artificial Sequence: Synthetic Destabilizing Domain (DD)

SEQ ID NO: 6556 - protein, 187 aa, Artificial Sequence; identical to SEQ ID NO: 3
  Description of Artificial Sequence: Synthetic Destabilizing Domain (DD)

SEQ ID NO: 6557 - protein, 187 aa, Artificial Sequence; identical to SEQ ID NO: 4
  Description of Artificial Sequence: Synthetic Destabilizing Domain (DD)

SEQ ID NO: 6558 - protein, 187 aa, Artificial Sequence; identical to SEQ ID NO: 5
  Description of Artificial Sequence: Synthetic Destabilizing Domain (DD)

SEQ ID NO: 6559 - protein, 187 aa, Artificial Sequence; identical to SEQ ID NO: 6
  Description of Artificial Sequence: Synthetic Destabilizing Domain (DD)

SEQ ID NO: 6560 - protein, 187 aa, Artificial Sequence; identical to SEQ ID NO: 7
  Description of Artificial Sequence: Synthetic Destabilizing Domain (DD)

SEQ ID NO: 6561 - protein, 187 aa, Artificial Sequence; identical to SEQ ID NO: 8
  Description of Artificial Sequence: Synthetic Destabilizing Domain (DD)

SEQ ID NO: 6562 - protein, 187 aa, Artificial Sequence; identical to SEQ ID NO: 9
  Description of Artificial Sequence: Synthetic Destabilizing Domain (DD)

SEQ ID NO: 6563 - protein, 187 aa, Artificial Sequence; identical to SEQ ID NO: 10
  Description of Artificial Sequence: Synthetic Destabilizing Domain (DD)

SEQ ID NO: 6564 - protein, 187 aa, Artificial Sequence; identical to SEQ ID NO: 11
  Description of Artificial Sequence: Synthetic Destabilizing Domain (DD)

SEQ ID NO: 6565 - protein, 187 aa, Artificial Sequence; identical to SEQ ID NO: 12
  Description of Artificial Sequence: Synthetic Destabilizing Domain (DD)

SEQ ID NO: 6566 - protein, 186 aa, Artificial Sequence; identical to SEQ ID NO: 13
  Description of Artificial Sequence: Synthetic Destabilizing Domain (DD)

SEQ ID NO: 6567 - protein, 187 aa, Artificial Sequence; identical to SEQ ID NO: 14
  Description of Artificial Sequence: Synthetic Destabilizing Domain (DD)

SEQ ID NO: 6568 - protein, 187 aa, Artificial Sequence; identical to SEQ ID NO: 15
  Description of Artificial Sequence: Synthetic Destabilizing Domain (DD)

SEQ ID NO: 6569 - protein, 187 aa, Artificial Sequence; identical to SEQ ID NO: 16
  Description of Artificial Sequence: Synthetic Destabilizing Domain (DD)

SEQ ID NO: 6570 - protein, 187 aa, Artificial Sequence; identical to SEQ ID NO: 17
  Description of Artificial Sequence: Synthetic Destabilizing Domain (DD)

SEQ ID NO: 6571 - protein, 187 aa, Artificial Sequence; identical to SEQ ID NO: 18
  Description of Artificial Sequence: Synthetic Destabilizing Domain (DD)

SEQ ID NO: 6572 - protein, 187 aa, Artificial Sequence; identical to SEQ ID NO: 19
  Description of Artificial Sequence: Synthetic Destabilizing Domain (DD)

SEQ ID NO: 6573 - protein, 187 aa, Artificial Sequence; identical to SEQ ID NO: 20
  Description of Artificial Sequence: Synthetic Destabilizing Domain (DD)

SEQ ID NO: 6574 - protein, 187 aa, Artificial Sequence; identical to SEQ ID NO: 21
  Description of Artificial Sequence: Synthetic Destabilizing Domain (DD)

SEQ ID NO: 6575 - protein, 187 aa, Artificial Sequence; identical to SEQ ID NO: 22
  Description of Artificial Sequence: Synthetic Destabilizing Domain (DD)

SEQ ID NO: 6576 - protein, 187 aa, Artificial Sequence; identical to SEQ ID NO: 23
  Description of Artificial Sequence: Synthetic Destabilizing Domain (DD)

SEQ ID NO: 6577 - protein, 187 aa, Artificial Sequence; identical to SEQ ID NO: 24
  Description of Artificial Sequence: Synthetic Destabilizing Domain (DD)

SEQ ID NO: 6578 - protein, 187 aa, Artificial Sequence; identical to SEQ ID NO: 25
  Description of Artificial Sequence: Synthetic Destabilizing Domain (DD)

SEQ ID NO: 6579 - protein, 187 aa, Artificial Sequence; identical to SEQ ID NO: 26
  Description of Artificial Sequence: Synthetic Destabilizing Domain (DD)

SEQ ID NO: 6580 - protein, 187 aa, Artificial Sequence; identical to SEQ ID NO: 27
  Description of Artificial Sequence: Synthetic Destabilizing Domain (DD)

SEQ ID NO: 6581 - protein, 187 aa, Artificial Sequence; identical to SEQ ID NO: 28
  Description of Artificial Sequence: Synthetic Destabilizing Domain (DD)

SEQ ID NO: 6582 - protein, 187 aa, Artificial Sequence; identical to SEQ ID NO: 29
  Description of Artificial Sequence: Synthetic Destabilizing Domain (DD)

SEQ ID NO: 6583 - protein, 187 aa, Artificial Sequence; identical to SEQ ID NO: 30
  Description of Artificial Sequence: Synthetic Destabilizing Domain (DD)

SEQ ID NO: 6584 - protein, 187 aa, Artificial Sequence; identical to SEQ ID NO: 31
  Description of Artificial Sequence: Synthetic Destabilizing Domain (DD)

SEQ ID NO: 6585 - protein, 186 aa, Artificial Sequence; identical to SEQ ID NO: 32
  Description of Artificial Sequence: Synthetic Destabilizing Domain (DD)

SEQ ID NO: 6586 - protein, 186 aa, Artificial Sequence; identical to SEQ ID NO: 33
  Description of Artificial Sequence: Synthetic Destabilizing Domain (DD)

SEQ ID NO: 6587 - protein, 186 aa, Artificial Sequence; identical to SEQ ID NO: 34
  Description of Artificial Sequence: Synthetic Destabilizing Domain (DD)

SEQ ID NO: 6588 - protein, 186 aa, Artificial Sequence; identical to SEQ ID NO: 35
  Description of Artificial Sequence: Synthetic Destabilizing Domain (DD)

SEQ ID NO: 6589 - protein, 186 aa, Artificial Sequence; identical to SEQ ID NO: 36
  Description of Artificial Sequence: Synthetic Destabilizing Domain (DD)

SEQ ID NO: 6590 - protein, 186 aa, Artificial Sequence; identical to SEQ ID NO: 37
  Description of Artificial Sequence: Synthetic Destabilizing Domain (DD)

SEQ ID NO: 6591 - protein, 186 aa, Artificial Sequence; identical to SEQ ID NO: 38
  Description of Artificial Sequence: Synthetic Destabilizing Domain (DD)

SEQ ID NO: 6592 - protein, 186 aa, Artificial Sequence; identical to SEQ ID NO: 39
  Description of Artificial Sequence: Synthetic Destabilizing Domain (DD)

SEQ ID NO: 6593 - protein, 186 aa, Artificial Sequence; identical to SEQ ID NO: 40
  Description of Artificial Sequence: Synthetic Destabilizing Domain (DD)

SEQ ID NO: 6594 - protein, 186 aa, Artificial Sequence; identical to SEQ ID NO: 41
  Description of Artificial Sequence: Synthetic Destabilizing Domain (DD)

SEQ ID NO: 6595 - protein, 186 aa, Artificial Sequence; identical to SEQ ID NO: 42
  Description of Artificial Sequence: Synthetic Destabilizing Domain (DD)

SEQ ID NO: 6596 - protein, 187 aa, Artificial Sequence; identical to SEQ ID NO: 43
  Description of Artificial Sequence: Synthetic Destabilizing Domain (DD)

SEQ ID NO: 6597 - protein, 187 aa, Artificial Sequence; identical to SEQ ID NO: 44
  Description of Artificial Sequence: Synthetic Destabilizing Domain (DD)

SEQ ID NO: 6598 - protein, 187 aa, Artificial Sequence; identical to SEQ ID NO: 45
  Description of Artificial Sequence: Synthetic Destabilizing Domain (DD)

SEQ ID NO: 6599 - protein, 187 aa, Artificial Sequence; identical to SEQ ID NO: 46
  Description of Artificial Sequence: Synthetic Destabilizing Domain (DD)

SEQ ID NO: 6600 - protein, 187 aa, Artificial Sequence; identical to SEQ ID NO: 47
  Description of Artificial Sequence: Synthetic Destabilizing Domain (DD)

SEQ ID NO: 6601 - protein, 187 aa, Artificial Sequence; identical to SEQ ID NO: 48
  Description of Artificial Sequence: Synthetic Destabilizing Domain (DD)

SEQ ID NO: 6602 - protein, 187 aa, Artificial Sequence; identical to SEQ ID NO: 49
  Description of Artificial Sequence: Synthetic Destabilizing Domain (DD)

SEQ ID NO: 6603 - protein, 187 aa, Artificial Sequence; identical to SEQ ID NO: 50
  Description of Artificial Sequence: Synthetic Destabilizing Domain (DD)

SEQ ID NO: 6604 - protein, 187 aa, Artificial Sequence; identical to SEQ ID NO: 51
  Description of Artificial Sequence: Synthetic Destabilizing Domain (DD)

SEQ ID NO: 6605 - protein, 187 aa, Artificial Sequence; identical to SEQ ID NO: 52
  Description of Artificial Sequence: Synthetic Destabilizing Domain (DD)

SEQ ID NO: 6606 - protein, 187 aa, Artificial Sequence; identical to SEQ ID NO: 53
  Description of Artificial Sequence: Synthetic Destabilizing Domain (DD)

SEQ ID NO: 6607 - protein, 187 aa, Artificial Sequence; identical to SEQ ID NO: 54
  Description of Artificial Sequence: Synthetic Destabilizing Domain (DD)

SEQ ID NO: 6608 - protein, 186 aa, Artificial Sequence; identical to SEQ ID NO: 55
  Description of Artificial Sequence: Synthetic Destabilizing Domain (DD)

SEQ ID NO: 6609 - protein, 186 aa, Artificial Sequence; identical to SEQ ID NO: 56
  Description of Artificial Sequence: Synthetic Destabilizing Domain (DD)

SEQ ID NO: 6610 - protein, 186 aa, Artificial Sequence; identical to SEQ ID NO: 57
  Description of Artificial Sequence: Synthetic Destabilizing Domain (DD)

SEQ ID NO: 6611 - protein, 186 aa, Artificial Sequence; identical to SEQ ID NO: 1196
  Description of Artificial Sequence: Synthetic Destabilizing Domain (DD)

SEQ ID NO: 6612 - protein, 187 aa, Artificial Sequence; identical to SEQ ID NO: 59
  Description of Artificial Sequence: Synthetic Destabilizing Domain (DD)

SEQ ID NO: 6613 - protein, 187 aa, Artificial Sequence; identical to SEQ ID NO: 60
  Description of Artificial Sequence: Synthetic Destabilizing Domain (DD)

SEQ ID NO: 6614 - protein, 186 aa, Artificial Sequence; identical to SEQ ID NO: 61
  Description of Artificial Sequence: Synthetic Destabilizing Domain (DD)

SEQ ID NO: 6615 - protein, 187 aa, Artificial Sequence; identical to SEQ ID NO: 62
  Description of Artificial Sequence: Synthetic Destabilizing Domain (DD)

SEQ ID NO: 6616 - protein, 187 aa, Artificial Sequence; identical to SEQ ID NO: 63
  Description of Artificial Sequence: Synthetic Destabilizing Domain (DD)

SEQ ID NO: 6617 - protein, 187 aa, Artificial Sequence; identical to SEQ ID NO: 64
  Description of Artificial Sequence: Synthetic Destabilizing Domain (DD)

SEQ ID NO: 6618 - protein, 187 aa, Artificial Sequence; identical to SEQ ID NO: 65
  Description of Artificial Sequence: Synthetic Destabilizing Domain (DD)

SEQ ID NO: 6619 - protein, 187 aa, Artificial Sequence; identical to SEQ ID NO: 66
  Description of Artificial Sequence: Synthetic Destabilizing Domain (DD)

SEQ ID NO: 6620 - protein, 187 aa, Artificial Sequence; identical to SEQ ID NO: 67
  Description of Artificial Sequence: Synthetic Destabilizing Domain (DD)

SEQ ID NO: 6621 - protein, 187 aa, Artificial Sequence; identical to SEQ ID NO: 68
  Description of Artificial Sequence: Synthetic Destabilizing Domain (DD)

SEQ ID NO: 6622 - protein, 187 aa, Artificial Sequence; identical to SEQ ID NO: 69
  Description of Artificial Sequence: Synthetic Destabilizing Domain (DD)

SEQ ID NO: 6623 - protein, 187 aa, Artificial Sequence; identical to SEQ ID NO: 70
  Description of Artificial Sequence: Synthetic Destabilizing Domain (DD)

SEQ ID NO: 6624 - protein, 186 aa, Artificial Sequence; identical to SEQ ID NO: 71
  Description of Artificial Sequence: Synthetic Destabilizing Domain (DD)

SEQ ID NO: 6625 - DNA, 1305 bp, Artificial Sequence; identical to SEQ ID NO: 142
  Description of Artificial Sequence: Synthetic polynucleotide

SEQ ID NO: 6626 - DNA, 1302 bp, Artificial Sequence; identical to SEQ ID NO: 143
  Description of Artificial Sequence: Synthetic polynucleotide

SEQ ID NO: 6627 - DNA, 1215 bp, Artificial Sequence; identical to SEQ ID NO: 144
  Description of Artificial Sequence: Synthetic polynucleotide

SEQ ID NO: 6628 - DNA, 1305 bp, Artificial Sequence; identical to SEQ ID NO: 145
  Description of Artificial Sequence: Synthetic polynucleotide

SEQ ID NO: 6629 - DNA, 1305 bp, Artificial Sequence; identical to SEQ ID NO: 146
  Description of Artificial Sequence: Synthetic polynucleotide

SEQ ID NO: 6630 - DNA, 1305 bp, Artificial Sequence; identical to SEQ ID NO: 147
  Description of Artificial Sequence: Synthetic polynucleotide

SEQ ID NO: 6631 - DNA, 1305 bp, Artificial Sequence; identical to SEQ ID NO: 148
  Description of Artificial Sequence: Synthetic polynucleotide

SEQ ID NO: 6632 - DNA, 1305 bp, Artificial Sequence; identical to SEQ ID NO: 149
  Description of Artificial Sequence: Synthetic polynucleotide

SEQ ID NO: 6633 - DNA, 1305 bp, Artificial Sequence; identical to SEQ ID NO: 150
  Description of Artificial Sequence: Synthetic polynucleotide

SEQ ID NO: 6634 - DNA, 1305 bp, Artificial Sequence; identical to SEQ ID NO: 151
  Description of Artificial Sequence: Synthetic polynucleotide

SEQ ID NO: 6635 - DNA, 1305 bp, Artificial Sequence; identical to SEQ ID NO: 152
  Description of Artificial Sequence: Synthetic polynucleotide

SEQ ID NO: 6636 - DNA, 1305 bp, Artificial Sequence; identical to SEQ ID NO: 153
  Description of Artificial Sequence: Synthetic polynucleotide

SEQ ID NO: 6637 - DNA, 1305 bp, Artificial Sequence; identical to SEQ ID NO: 154
  Description of Artificial Sequence: Synthetic polynucleotide

SEQ ID NO: 6638 - DNA, 1302 bp, Artificial Sequence; identical to SEQ ID NO: 155
  Description of Artificial Sequence: Synthetic polynucleotide

SEQ ID NO: 6639 - DNA, 1302 bp, Artificial Sequence; identical to SEQ ID NO: 156
  Description of Artificial Sequence: Synthetic polynucleotide

SEQ ID NO: 6640 - DNA, 1302 bp, Artificial Sequence; identical to SEQ ID NO: 157
  Description of Artificial Sequence: Synthetic polynucleotide

SEQ ID NO: 6641 - DNA, 1302 bp, Artificial Sequence; identical to SEQ ID NO: 158
  Description of Artificial Sequence: Synthetic polynucleotide

SEQ ID NO: 6642 - DNA, 1302 bp, Artificial Sequence; identical to SEQ ID NO: 159
  Description of Artificial Sequence: Synthetic polynucleotide

SEQ ID NO: 6643 - DNA, 1302 bp, Artificial Sequence; identical to SEQ ID NO: 160
  Description of Artificial Sequence: Synthetic polynucleotide

SEQ ID NO: 6644 - DNA, 1302 bp, Artificial Sequence; identical to SEQ ID NO: 161
  Description of Artificial Sequence: Synthetic polynucleotide

SEQ ID NO: 6645 - DNA, 1302 bp, Artificial Sequence; identical to SEQ ID NO: 162
  Description of Artificial Sequence: Synthetic polynucleotide

SEQ ID NO: 6646 - DNA, 1305 bp, Artificial Sequence; identical to SEQ ID NO: 154
  Description of Artificial Sequence: Synthetic polynucleotide

SEQ ID NO: 6647 - DNA, 1302 bp, Artificial Sequence; identical to SEQ ID NO: 164
  Description of Artificial Sequence: Synthetic polynucleotide

SEQ ID NO: 6648 - DNA, 2034 bp, Artificial Sequence; identical to SEQ ID NO: 165
  Description of Artificial Sequence: Synthetic Construct

SEQ ID NO: 6649 - DNA, 2034 bp, Artificial Sequence; identical to SEQ ID NO: 166
  Description of Artificial Sequence: Synthetic Construct

SEQ ID NO: 6650 - DNA, 2034 bp, Artificial Sequence; identical to SEQ ID NO: 167
  Description of Artificial Sequence: Synthetic Construct

SEQ ID NO: 6651 - DNA, 2034 bp, Artificial Sequence; identical to SEQ ID NO: 1707
  Description of Artificial Sequence: Synthetic Construct

SEQ ID NO: 6652 - DNA, 1188 bp, Artificial Sequence; identical to SEQ ID NO: 169
  Description of Artificial Sequence: Synthetic polynucleotide

SEQ ID NO: 6653 - DNA, 1752 bp, Artificial Sequence; identical to SEQ ID NO: 170
  Description of Artificial Sequence: Synthetic polynucleotide

SEQ ID NO: 6654 - DNA, 1752 bp, Artificial Sequence; identical to SEQ ID NO: 171
  Description of Artificial Sequence: Synthetic polynucleotide

SEQ ID NO: 6655 - DNA, 1623 bp, Artificial Sequence; identical to SEQ ID NO: 172
  Description of Artificial Sequence: Synthetic polynucleotide

SEQ ID NO: 6656 - DNA, 2214 bp, Artificial Sequence; identical to SEQ ID NO: 173
  Description of Artificial Sequence: Synthetic polynucleotide

SEQ ID NO: 6657 - DNA, 2062 bp, Artificial Sequence; identical to SEQ ID NO: 174
  Description of Artificial Sequence: Synthetic Construct

SEQ ID NO: 6658 - DNA, 2062 bp, Artificial Sequence; identical to SEQ ID NO: 175
  Description of Artificial Sequence: Synthetic Construct

SEQ ID NO: 6659 - DNA, 2061 bp, Artificial Sequence; identical to SEQ ID NO: 176
  Description of Artificial Sequence: Synthetic Construct

SEQ ID NO: 6660 - DNA, 2061 bp, Artificial Sequence; identical to SEQ ID NO: 177
  Description of Artificial Sequence: Synthetic Construct

SEQ ID NO: 6661 - DNA, 1824 bp, Artificial Sequence; identical to SEQ ID NO: 178
  Description of Artificial Sequence: Synthetic polynucleotide

SEQ ID NO: 6662 - DNA, 1824 bp, Artificial Sequence; identical to SEQ ID NO: 179
  Description of Artificial Sequence: Synthetic polynucleotide

SEQ ID NO: 6663 - DNA, 1824 bp, Artificial Sequence; identical to SEQ ID NO: 180
  Description of Artificial Sequence: Synthetic polynucleotide

SEQ ID NO: 6664 - DNA, 2217 bp, Artificial Sequence; identical to SEQ ID NO: 181
  Description of Artificial Sequence: Synthetic polynucleotide

SEQ ID NO: 6665 - DNA, 2217 bp, Artificial Sequence; identical to SEQ ID NO: 182
  Description of Artificial Sequence: Synthetic polynucleotide

SEQ ID NO: 6666 - DNA, 2217 bp, Artificial Sequence; identical to SEQ ID NO: 183
  Description of Artificial Sequence: Synthetic polynucleotide

SEQ ID NO: 6667 - DNA, 2217 bp, Artificial Sequence; identical to SEQ ID NO: 184
  Description of Artificial Sequence: Synthetic polynucleotide

SEQ ID NO: 6668 - DNA, 1281 bp, Artificial Sequence; identical to SEQ ID NO: 185
  Description of Artificial Sequence: Synthetic polynucleotide

SEQ ID NO: 6669 - DNA, 1302 bp, Artificial Sequence; identical to SEQ ID NO: 186
  Description of Artificial Sequence: Synthetic Construct

SEQ ID NO: 6670 - DNA, 1302 bp, Artificial Sequence; identical to SEQ ID NO: 187
  Description of Artificial Sequence: Synthetic Construct

SEQ ID NO: 6671 - DNA, 1302 bp, Artificial Sequence; identical to SEQ ID NO: 188
  Description of Artificial Sequence: Synthetic Construct

SEQ ID NO: 6672 - DNA, 1302 bp, Artificial Sequence; identical to SEQ ID NO: 189
  Description of Artificial Sequence: Synthetic Construct

SEQ ID NO: 6673 - DNA, 1302 bp, Artificial Sequence; identical to SEQ ID NO: 190
  Description of Artificial Sequence: Synthetic Construct

SEQ ID NO: 6674 - protein, 107 aa, Homo sapiens; identical to SEQ ID NO: 192

SEQ ID NO: 6675 - protein, 159 aa, Escherichia coli [sequence omitted]

SEQ ID NO: 6676 - protein, 187 aa, Homo sapiens; identical to SEQ ID NO: 1

SEQ ID NO: 6677 - protein, 327 aa, Homo sapiens; identical to SEQ ID NO: 195

SEQ ID NO: 6678 - protein, 189 aa, Homo sapiens; identical to SEQ ID NO: 196

SEQ ID NO: 6679 - protein, 260 aa, Homo sapiens; identical to SEQ ID NO: 197

SEQ ID NO: 6680 - protein, 231 aa, Homo sapiens; identical to SEQ ID NO: 198

SEQ ID NO: 6681 - protein, 449 aa, Artificial Sequence; identical to SEQ ID NO: 199
  Description of Artificial Sequence: Synthetic heavy chain variable domain

SEQ ID NO: 6682 - protein, 223 aa, Artificial Sequence; identical to SEQ ID NO: 200
  Description of Artificial Sequence: Synthetic heavy chain variable domain

SEQ ID NO: 6683 - protein, 234 aa, Artificial Sequence; identical to SEQ ID NO: 201
  Description of Artificial Sequence: Synthetic heavy chain variable domain

SEQ ID NO: 6684 - protein, 460 aa, Artificial Sequence; identical to SEQ ID NO: 202
  Description of Artificial Sequence: Synthetic heavy chain variable domain

SEQ ID NO: 6685 - protein, 241 aa, Artificial Sequence; identical to SEQ ID NO: 203
  Description of Artificial Sequence: Synthetic heavy chain variable domain

SEQ ID NO: 6686 - protein, 471 aa, Artificial Sequence; identical to SEQ ID NO: 204
  Description of Artificial Sequence: Synthetic heavy chain variable domain

SEQ ID NO: 6687 - protein, 120 aa, Artificial Sequence; identical to SEQ ID NO: 205
  Description of Artificial Sequence: Synthetic heavy chain variable domain

SEQ ID NO: 6688 - protein, 111 aa, Artificial Sequence; identical to SEQ ID NO: 206
  Description of Artificial Sequence: Synthetic heavy chain variable domain

SEQ ID NO: 6689 - protein, 464 aa, Artificial Sequence; identical to SEQ ID NO: 207
  Description of Artificial Sequence: Synthetic heavy chain variable domain

SEQ ID NO: 6690 - protein, 137 aa, Artificial Sequence; identical to SEQ ID NO: 208
  Description of Artificial Sequence: Synthetic heavy chain variable domain

SEQ ID NO: 6691 - protein, 124 aa, Artificial Sequence; identical to SEQ ID NO: 209
  Description of Artificial Sequence: Synthetic heavy chain variable domain

SEQ ID NO: 6692 - protein, 130 aa, Artificial Sequence; identical to SEQ ID NO: 210
  Description of Artificial Sequence: Synthetic heavy chain variable domain

SEQ ID NO: 6693 - protein, 125 aa, Artificial Sequence; identical to SEQ ID NO: 211
  Description of Artificial Sequence: Synthetic heavy chain variable domain

SEQ ID NO: 6694 - protein, 125 aa, Artificial Sequence; identical to SEQ ID NO: 212
  Description of Artificial Sequence: Synthetic heavy chain variable domain

SEQ ID NO: 6695 - protein, 228 aa, Artificial Sequence; identical to SEQ ID NO: 213
  Description of Artificial Sequence: Synthetic heavy chain variable domain

SEQ ID NO: 6696 - protein, 98 aa, Artificial Sequence; identical to SEQ ID NO: 214
  Description of Artificial Sequence: Synthetic heavy chain variable domain
  MOD_RES (64)..(65): Any amino acid
  MOD_RES (68)..(69): Any amino acid
  MOD_RES (93)..(93): Any amino acid
  MOD_RES (98)..(98): Any amino acid

SEQ ID NO: 6697 - protein, 125 aa, Artificial Sequence; identical to SEQ ID NO: 215
  Description of Artificial Sequence: Synthetic heavy chain variable domain
  MOD_RES (76)..(76): Any amino acid

SEQ ID NO: 6698 - protein, 125 aa, Artificial Sequence; identical to SEQ ID NO: 216
  Description of Artificial Sequence: Synthetic heavy chain variable domain

SEQ ID NO: 6699 - protein, 125 aa, Artificial Sequence; identical to SEQ ID NO: 217
  Description of Artificial Sequence: Synthetic heavy chain variable domain

SEQ ID NO: 6700 - protein, 125 aa, Artificial Sequence; identical to SEQ ID NO: 218
  Description of Artificial Sequence: Synthetic heavy chain variable domain

SEQ ID NO: 6701 - protein, 125 aa, Artificial Sequence; identical to SEQ ID NO: 219
  Description of Artificial Sequence: Synthetic heavy chain variable domain

SEQ ID NO: 6702 - protein, 125 aa, Artificial Sequence; identical to SEQ ID NO: 220
  Description of Artificial Sequence: Synthetic heavy chain variable domain

SEQ ID NO: 6703 - protein, 125 aa, Artificial Sequence; identical to SEQ ID NO: 221
  Description of Artificial Sequence: Synthetic heavy chain variable domain

SEQ ID NO: 6704 - protein, 464 aa, Artificial Sequence; identical to SEQ ID NO: 207
  Description of Artificial Sequence: Synthetic heavy chain variable domain

SEQ ID NO: 6705 - protein, 120 aa, Artificial Sequence; identical to SEQ ID NO: 205
  Description of Artificial Sequence: Synthetic heavy chain variable domain

SEQ ID NO: 6706 - protein, 218 aa, Artificial Sequence; identical to SEQ ID NO: 224
  Description of Artificial Sequence: Synthetic heavy chain variable domain

SEQ ID NO: 6707 - protein, 219 aa, Artificial Sequence; identical to SEQ ID NO: 225
  Description of Artificial Sequence: Synthetic heavy chain variable domain

SEQ ID NO: 6708 - protein, 460 aa, Artificial Sequence; identical to SEQ ID NO: 202
  Description of Artificial Sequence: Synthetic heavy chain variable domain

SEQ ID NO: 6709 - protein, 242 aa, Artificial Sequence; identical to SEQ ID NO: 227
  Description of Artificial Sequence: Synthetic heavy chain variable domain

SEQ ID NO: 6710 - protein, 471 aa, Artificial Sequence; identical to SEQ ID NO: 204
  Description of Artificial Sequence: Synthetic heavy chain variable domain

SEQ ID NO: 6711 - protein, 118 aa, Artificial Sequence; identical to SEQ ID NO: 229
  Description of Artificial Sequence: Synthetic heavy chain variable domain

SEQ ID NO: 6712 - protein, 119 aa, Artificial Sequence; identical to SEQ ID NO: 230
  Description of Artificial Sequence: Synthetic heavy chain variable domain

SEQ ID NO: 6713 - protein, 112 aa, Artificial Sequence; identical to SEQ ID NO: 231
  Description of Artificial Sequence: Synthetic light chain variable domain

SEQ ID NO: 6714 - protein, 447 aa, Artificial Sequence; identical to SEQ ID NO: 232
  Description of Artificial Sequence: Synthetic light chain variable domain

SEQ ID NO: 6715 - protein, 111 aa, Artificial Sequence; identical to SEQ ID NO: 233
  Description of Artificial Sequence: Synthetic light chain variable domain

SEQ ID NO: 6716 - protein, 107 aa, Artificial Sequence; identical to SEQ ID NO: 234
  Description of Artificial Sequence: Synthetic light chain variable domain

SEQ ID NO: 6717 - protein, 214 aa, Artificial Sequence; identical to SEQ ID NO: 235
  Description of Artificial Sequence: Synthetic light chain variable domain

SEQ ID NO: 6718 - protein, 237 aa, Artificial Sequence; identical to SEQ ID NO: 236
  Description of Artificial Sequence: Synthetic light chain variable domain

SEQ ID NO: 6719 - protein, 107 aa, Artificial Sequence; identical to SEQ ID NO: 237
  Description of Artificial Sequence: Synthetic light chain variable domain

SEQ ID NO: 6720 - protein, 107 aa, Artificial Sequence; identical to SEQ ID NO: 237
  Description of Artificial Sequence: Synthetic light chain variable domain

SEQ ID NO: 6721 - protein, 115 aa, Artificial Sequence; identical to SEQ ID NO: 239
  Description of Artificial Sequence: Synthetic light chain variable domain

SEQ ID NO: 6722 - protein, 107 aa, Artificial Sequence; identical to SEQ ID NO: 237
  Description of Artificial Sequence: Synthetic light chain variable domain

SEQ ID NO: 6723 - protein, 112 aa, Artificial Sequence; identical to SEQ ID NO: 241
  Description of Artificial Sequence: Synthetic light chain variable domain

SEQ ID NO: 6724 - protein, 106 aa, Artificial Sequence; identical to SEQ ID NO: 242
  Description of Artificial Sequence: Synthetic light chain variable domain

SEQ ID NO: 6725 - protein, 106 aa, Artificial Sequence; identical to SEQ ID NO: 243
  Description of Artificial Sequence: Synthetic light chain variable domain

SEQ ID NO: 6726 - protein, 110 aa, Artificial Sequence; identical to SEQ ID NO: 244
  Description of Artificial Sequence: Synthetic light chain variable domain

SEQ ID NO: 6727 - protein, 109 aa, Artificial Sequence; identical to SEQ ID NO: 245
  Description of Artificial Sequence: Synthetic light chain variable domain

SEQ ID NO: 6728 - protein, 108 aa, Artificial Sequence; identical to SEQ ID NO: 246
  Description of Artificial Sequence: Synthetic light chain variable domain

SEQ ID NO: 6729 - protein, 107 aa, Artificial Sequence; identical to SEQ ID NO: 247
  Description of Artificial Sequence: Synthetic light chain variable domain

SEQ ID NO: 6730 - protein, 109 aa, Artificial Sequence; identical to SEQ ID NO: 248
  Description of Artificial Sequence: Synthetic light chain variable domain

SEQ ID NO: 6731 - protein, 109 aa, Artificial Sequence; identical to SEQ ID NO: 249
  Description of Artificial Sequence: Synthetic light chain variable domain

SEQ ID NO: 6732 - protein, 111 aa, Artificial Sequence; identical to SEQ ID NO: 250
  Description of Artificial Sequence: Synthetic light chain variable domain

SEQ ID NO: 6733 - protein, 109 aa, Artificial Sequence; identical to SEQ ID NO: 251
  Description of Artificial Sequence: Synthetic light chain variable domain
  MOD_RES (5)..(6): Any amino acid
  MOD_RES (8)..(9): Any amino acid
  MOD_RES (93)..(93): Any amino acid
  MOD_RES (104)..(104): Any amino acid

SEQ ID NO: 6734 - protein, 112 aa, Artificial Sequence; identical to SEQ ID NO: 252
  Description of Artificial Sequence: Synthetic light chain variable domain
  MOD_RES (61)..(61): Any amino acid

SEQ ID NO: 6735 - protein, 112 aa, Artificial Sequence; identical to SEQ ID NO: 253
  Description of Artificial Sequence: Synthetic light chain variable domain

SEQ ID NO: 6736 - protein, 110 aa, Artificial Sequence; identical to SEQ ID NO: 254
  Description of Artificial Sequence: Synthetic light chain variable domain

SEQ ID NO: 6737 - protein, 112 aa, Artificial Sequence; identical to SEQ ID NO: 255
  Description of Artificial Sequence: Synthetic light chain variable domain

SEQ ID NO: 6738 - protein, 111 aa, Artificial Sequence; identical to SEQ ID NO: 256
  Description of Artificial Sequence: Synthetic light chain variable domain

SEQ ID NO: 6739 - protein, 111 aa, Artificial Sequence; identical to SEQ ID NO: 257
  Description of Artificial Sequence: Synthetic light chain variable domain

SEQ ID NO: 6740 - protein, 106 aa, Artificial Sequence; identical to SEQ ID NO: 258
  Description of Artificial Sequence: Synthetic light chain variable domain

SEQ ID NO: 6741 - protein, 99 aa, Artificial Sequence; identical to SEQ ID NO: 259
  Description of Artificial Sequence: Synthetic light chain variable domain

SEQ ID NO: 6742 - protein, 110 aa, Artificial Sequence; identical to SEQ ID NO: 260
  Description of Artificial Sequence: Synthetic light chain variable domain

SEQ ID NO: 6743 - protein, 111 aa, Artificial Sequence; identical to SEQ ID NO: 261
  Description of Artificial Sequence: Synthetic light chain variable domain

SEQ ID NO: 6744 - protein, 124 aa, Artificial Sequence; identical to SEQ ID NO: 262
  Description of Artificial Sequence: Synthetic light chain variable domain

SEQ ID NO: 6745 - protein, 239 aa, Artificial Sequence; identical to SEQ ID NO: 263
  Description of Artificial Sequence: Synthetic light chain variable domain

SEQ ID NO: 6746 - protein, 111 aa, Artificial Sequence; identical to SEQ ID NO: 264
  Description of Artificial Sequence: Synthetic light chain variable domain

SEQ ID NO: 6747 - protein, 110 aa, Artificial Sequence; identical to SEQ ID NO: 265
  Description of Artificial Sequence: Synthetic light chain variable domain

SEQ ID NO: 6748 - protein, 111 aa, Artificial Sequence; identical to SEQ ID NO: 266
  Description of Artificial Sequence: Synthetic light chain variable domain

SEQ ID NO: 6749 - protein, 109 aa, Artificial Sequence; identical to SEQ ID NO: 270
  Description of Artificial Sequence: Synthetic light chain variable domain

SEQ ID NO: 6750 - protein, 111 aa, Artificial Sequence; identical to SEQ ID NO: 271
  Description of Artificial Sequence: Synthetic light chain variable domain

SEQ ID NO: 6751 - protein, 121 aa, Artificial Sequence; identical to SEQ ID NO: 272
  Description of Artificial Sequence: Synthetic light chain variable domain

SEQ ID NO: 6752 - protein, 263 aa, Artificial Sequence; identical to SEQ ID NO: 273
  Description of Artificial Sequence: Synthetic single chain variable fragment

SEQ ID NO: 6753 - protein, 247 aa, Artificial Sequence; identical to SEQ ID NO: 274
  Description of Artificial Sequence: Synthetic single chain variable fragment

SEQ ID NO: 6754 - protein, 242 aa, Artificial Sequence; identical to SEQ ID NO: 275
  Description of Artificial Sequence: Synthetic single chain variable fragment

SEQ ID NO: 6755 - protein, 247 aa, Artificial Sequence; identical to SEQ ID NO: 276
  Description of Artificial Sequence: Synthetic single chain variable fragment

SEQ ID NO: 6756 - protein, 248 aa, Artificial Sequence; identical to SEQ ID NO: 277
  Description of Artificial Sequence: Synthetic single chain variable fragment

SEQ ID NO: 6757 - protein, 242 aa, Artificial Sequence; identical to SEQ ID NO: 278
  Description of Artificial Sequence: Synthetic single chain variable fragment

SEQ ID NO: 6758 - protein, 242 aa, Artificial Sequence; identical to SEQ ID NO: 279
  Description of Artificial Sequence: Synthetic single chain variable fragment

SEQ ID NO: 6759 - protein, 242 aa, Artificial Sequence; identical to SEQ ID NO: 280
  Description of Artificial Sequence: Synthetic single chain variable fragment

SEQ ID NO: 6760 - protein, 246 aa, Artificial Sequence; identical to SEQ ID NO: 281
  Description of Artificial Sequence: Synthetic single chain variable fragment

SEQ ID NO: 6761 - protein, 252 aa, Artificial Sequence; identical to SEQ ID NO: 282
  Description of Artificial Sequence: Synthetic single chain variable fragment

SEQ ID NO: 6762 - protein, 249 aa, Artificial Sequence; identical to SEQ ID NO: 283
  Description of Artificial Sequence: Synthetic single chain variable fragment

SEQ ID NO: 6763 - protein, 249 aa, Artificial Sequence; identical to SEQ ID NO: 284
  Description of Artificial Sequence: Synthetic single chain variable fragment

SEQ ID NO: 6764 - protein, 251 aa, Artificial Sequence; identical to SEQ ID NO: 285
  Description of Artificial Sequence: Synthetic single chain variable fragment

SEQ ID NO: 6765 - protein, 252 aa, Artificial Sequence; identical to SEQ ID NO: 286
  Description of Artificial Sequence: Synthetic single chain variable fragment

SEQ ID NO: 6766 - protein, 252 aa, Artificial Sequence; identical to SEQ ID NO: 286
  Description of Artificial Sequence: Synthetic single chain variable fragment

SEQ ID NO: 6767 - protein, 252 aa, Artificial Sequence; identical to SEQ ID NO: 288
  Description of Artificial Sequence: Synthetic single chain variable fragment

SEQ ID NO: 6768 - protein, 252 aa, Artificial Sequence; identical to SEQ ID NO: 288
  Description of Artificial Sequence: Synthetic single chain variable fragment

SEQ ID NO: 6769 - protein, 252 aa, Artificial Sequence; identical to SEQ ID NO: 288
  Description of Artificial Sequence: Synthetic single chain variable fragment

SEQ ID NO: 6770 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 6771 - protein, 252 aa, Artificial Sequence; identical to SEQ ID NO: 286
  Description of Artificial Sequence: Synthetic single chain variable fragment

SEQ ID NO: 6772 - protein, 250 aa, Artificial Sequence; identical to SEQ ID NO: 293
  Description of Artificial Sequence: Synthetic single chain variable fragment

SEQ ID NO: 6773 - protein, 252 aa, Artificial Sequence; identical to SEQ ID NO: 294
  Description of Artificial Sequence: Synthetic single chain variable fragment

SEQ ID NO: 6774 - protein, 236 aa, Artificial Sequence; identical to SEQ ID NO: 295
  Description of Artificial Sequence: Synthetic single chain variable fragment

SEQ ID NO: 6775 - protein, 251 aa, Artificial Sequence; identical to SEQ ID NO: 296
  Description of Artificial Sequence: Synthetic single chain variable fragment

SEQ ID NO: 6776 - protein, 246 aa, Artificial Sequence; identical to SEQ ID NO: 297
  Description of Artificial Sequence: Synthetic single chain variable fragment

SEQ ID NO: 6777 - protein, 239 aa, Artificial Sequence; identical to SEQ ID NO: 298
  Description of Artificial Sequence: Synthetic single chain variable fragment

SEQ ID NO: 6778 - protein, 250 aa, Artificial Sequence; identical to SEQ ID NO: 299
  Description of Artificial Sequence: Synthetic single chain variable fragment

SEQ ID NO: 6779 - protein, 251 aa, Artificial Sequence; identical to SEQ ID NO: 300
  Description of Artificial Sequence: Synthetic single chain variable fragment

SEQ ID NO: 6780 - protein, 242 aa, Artificial Sequence; identical to SEQ ID NO: 301
  Description of Artificial Sequence: Synthetic single chain variable fragment

SEQ ID NO: 6781 - protein, 242 aa, Artificial Sequence; identical to SEQ ID NO: 302
  Description of Artificial Sequence: Synthetic single chain variable fragment

SEQ ID NO: 6782 - protein, 246 aa, Artificial Sequence; identical to SEQ ID NO: 303
  Description of Artificial Sequence: Synthetic single chain variable fragment

SEQ ID NO: 6783 - protein, 249 aa, Artificial Sequence; identical to SEQ ID NO: 304
  Description of Artificial Sequence: Synthetic single chain variable fragment

SEQ ID NO: 6784 - protein, 249 aa, Artificial Sequence; identical to SEQ ID NO: 305
  Description of Artificial Sequence: Synthetic single chain variable fragment

SEQ ID NO: 6785 - protein, 252 aa, Artificial Sequence; identical to SEQ ID NO: 288
  Description of Artificial Sequence: Synthetic single chain variable fragment

SEQ ID NO: 6786 - protein, 495 aa, Artificial Sequence; identical to SEQ ID NO: 307
  Description of Artificial Sequence: Synthetic single chain variable fragment

SEQ ID NO: 6787 - protein, 247 aa, Artificial Sequence; identical to SEQ ID NO: 308
  Description of Artificial Sequence: Synthetic single chain variable fragment

SEQ ID NO: 6788 - protein, 251 aa, Artificial Sequence; identical to SEQ ID NO: 309
  Description of Artificial Sequence: Synthetic single chain variable fragment

SEQ ID NO: 6789 - protein, 250 aa, Artificial Sequence; identical to SEQ ID NO: 310
  Description of Artificial Sequence: Synthetic single chain variable fragment

SEQ ID NO: 6790 - protein, 247 aa, Artificial Sequence; identical to SEQ ID NO: 311
  Description of Artificial Sequence: Synthetic single chain variable fragment

SEQ ID NO: 6791 - protein, 248 aa, Artificial Sequence; identical to SEQ ID NO: 312
  Description of Artificial Sequence: Synthetic single chain variable fragment

SEQ ID NO: 6792 - protein, 242 aa, Artificial Sequence; identical to SEQ ID NO: 313
  Description of Artificial Sequence: Synthetic single chain variable fragment

SEQ ID NO: 6793 - protein, 251 aa, Artificial Sequence; identical to SEQ ID NO: 314
  Description of Artificial Sequence: Synthetic single chain variable fragment

SEQ ID NO: 6794 - protein, 247 aa, Artificial Sequence; identical to SEQ ID NO: 315
  Description of Artificial Sequence: Synthetic single chain variable fragment

SEQ ID NO: 6795 - protein, 250 aa, Artificial Sequence; identical to SEQ ID NO: 316
  Description of Artificial Sequence: Synthetic single chain variable fragment

SEQ ID NO: 6796 - protein, 252 aa, Artificial Sequence; identical to SEQ ID NO: 317
  Description of Artificial Sequence: Synthetic single chain variable fragment

SEQ ID NO: 6797 - protein, 247 aa, Artificial Sequence; identical to SEQ ID NO: 318
  Description of Artificial Sequence: Synthetic single chain variable fragment

SEQ ID NO: 6798 - protein, 247 aa, Artificial Sequence; identical to SEQ ID NO: 319
  Description of Artificial Sequence: Synthetic single chain variable fragment

SEQ ID NO: 6799 - protein, 249 aa, Artificial Sequence; identical to SEQ ID NO: 320
  Description of Artificial Sequence: Synthetic single chain variable fragment

SEQ ID NO: 6800 - protein, 251 aa, Artificial Sequence; identical to SEQ ID NO: 321
  Description of Artificial Sequence: Synthetic single chain variable fragment

SEQ ID NO: 6801 - protein, 247 aa, Artificial Sequence; identical to SEQ ID NO: 322
  Description of Artificial Sequence: Synthetic single chain variable fragment

SEQ ID NO: 6802 - protein, 241 aa, Artificial Sequence; identical to SEQ ID NO: 323
  Description of Artificial Sequence: Synthetic single chain variable fragment

SEQ ID NO: 6803 - protein, 248 aa, Artificial Sequence; identical to SEQ ID NO: 277
  Description of Artificial Sequence: Synthetic single chain variable fragment

SEQ ID NO: 6804 - protein, 246 aa, Artificial Sequence; identical to SEQ ID NO: 281
  Description of Artificial Sequence: Synthetic single chain variable fragment

SEQ ID NO: 6805 - protein, 252 aa, Artificial Sequence; identical to SEQ ID NO: 282
  Description of Artificial Sequence: Synthetic single chain variable fragment

SEQ ID NO: 6806 - protein, 249 aa, Artificial Sequence; identical to SEQ ID NO: 283
  Description of Artificial Sequence: Synthetic single chain variable fragment

SEQ ID NO: 6807 - protein, 249 aa, Artificial Sequence; identical to SEQ ID NO: 284
  Description of Artificial Sequence: Synthetic single chain variable fragment

SEQ ID NO: 6808 - protein, 251 aa, Artificial Sequence; identical to SEQ ID NO: 285
  Description of Artificial Sequence: Synthetic single chain variable fragment

SEQ ID NO: 6809 - protein, 252 aa, Artificial Sequence; identical to SEQ ID NO: 286
  Description of Artificial Sequence: Synthetic single chain variable fragment

SEQ ID NO: 6810 - protein, 252 aa, Artificial Sequence; identical to SEQ ID NO: 286
  Description of Artificial Sequence: Synthetic single chain variable fragment

SEQ ID NO: 6811 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 6812 - protein, 252 aa, Artificial Sequence; identical to SEQ ID NO: 288
  Description of Artificial Sequence: Synthetic single chain variable fragment

SEQ ID NO: 6813 - protein, 252 aa, Artificial Sequence; identical to SEQ ID NO: 288
  Description of Artificial Sequence: Synthetic single chain variable fragment

SEQ ID NO: 6814 - protein, 252 aa, Artificial Sequence; identical to SEQ ID NO: 288
  Description of Artificial Sequence: Synthetic single chain variable fragment

SEQ ID NO: 6815 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 6816 - protein, 252 aa, Artificial Sequence; identical to SEQ ID NO: 286
  Description of Artificial Sequence: Synthetic single chain variable fragment

SEQ ID NO: 6817 - protein, 250 aa, Artificial Sequence; identical to SEQ ID NO: 293
  Description of Artificial Sequence: Synthetic single chain variable fragment

SEQ ID NO: 6818 - protein, 252 aa, Artificial Sequence; identical to SEQ ID NO: 294
  Description of Artificial Sequence: Synthetic single chain variable fragment

SEQ ID NO: 6819 - protein, 236 aa, Artificial Sequence; identical to SEQ ID NO: 295
  Description of Artificial Sequence: Synthetic single chain variable fragment

SEQ ID NO: 6820 - protein, 251 aa, Artificial Sequence; identical to SEQ ID NO: 296
  Description of Artificial Sequence: Synthetic single chain variable fragment

SEQ ID NO: 6821 - protein, 246 aa, Artificial Sequence; identical to SEQ ID NO: 297
  Description of Artificial Sequence: Synthetic single chain variable fragment

SEQ ID NO: 6822 - protein, 239 aa, Artificial Sequence; identical to SEQ ID NO: 298
  Description of Artificial Sequence: Synthetic single chain variable fragment

SEQ ID NO: 6823 - protein, 250 aa, Artificial Sequence; identical to SEQ ID NO: 299
  Description of Artificial Sequence: Synthetic single chain variable fragment

SEQ ID NO: 6824 - protein, 251 aa, Artificial Sequence; identical to SEQ ID NO: 300
  Description of Artificial Sequence: Synthetic single chain variable fragment

SEQ ID NO: 6825 - protein, 273 aa, Artificial Sequence; identical to SEQ ID NO: 346
  Description of Artificial Sequence: Synthetic single chain variable fragment

SEQ ID NO: 6826 - protein, 270 aa, Artificial Sequence; identical to SEQ ID NO: 347
  Description of Artificial Sequence: Synthetic single chain variable fragment

SEQ ID NO: 6827 - protein, 277 aa, Artificial Sequence; identical to SEQ ID NO: 348
  Description of Artificial Sequence: Synthetic single chain variable fragment

SEQ ID NO: 6828 - protein, 246 aa, Artificial Sequence; identical to SEQ ID NO: 303
  Description of Artificial Sequence: Synthetic single chain variable fragment

SEQ ID NO: 6829 - protein, 249 aa, Artificial Sequence; identical to SEQ ID NO: 304
  Description of Artificial Sequence: Synthetic single chain variable fragment

SEQ ID NO: 6830 - protein, 249 aa, Artificial Sequence; identical to SEQ ID NO: 305
  Description of Artificial Sequence: Synthetic single chain variable fragment

SEQ ID NO: 6831 - protein, 252 aa, Artificial Sequence; identical to SEQ ID NO: 288
  Description of Artificial Sequence: Synthetic single chain variable fragment

SEQ ID NO: 6832 - protein, 251 aa, Artificial Sequence; identical to SEQ ID NO: 309
  Description of Artificial Sequence: Synthetic single chain variable fragment

SEQ ID NO: 6833 - protein, 250 aa, Artificial Sequence; identical to SEQ ID NO: 310
  Description of Artificial Sequence: Synthetic single chain variable fragment

SEQ ID NO: 6834 - protein, 247 aa, Artificial Sequence; identical to SEQ ID NO: 311
  Description of Artificial Sequence: Synthetic single chain variable fragment

SEQ ID NO: 6835 - protein, 248 aa, Artificial Sequence; identical to SEQ ID NO: 312
  Description of Artificial Sequence: Synthetic single chain variable fragment

SEQ ID NO: 6836 - protein, 251 aa, Artificial Sequence; identical to SEQ ID NO: 314
  Description of Artificial Sequence: Synthetic single chain variable fragment

SEQ ID NO: 6837 - protein, 250 aa, Artificial Sequence; identical to SEQ ID NO: 316
  Description of Artificial Sequence: Synthetic single chain variable fragment

SEQ ID NO: 6838 - protein, 249 aa, Artificial Sequence; identical to SEQ ID NO: 320
  Description of Artificial Sequence: Synthetic single chain variable fragment

SEQ ID NO: 6839 - protein, 251 aa, Artificial Sequence; identical to SEQ ID NO: 321
  Description of Artificial Sequence: Synthetic single chain variable fragment

SEQ ID NO: 6840 - protein, 249 aa, Artificial Sequence; identical to SEQ ID NO: 284
  Description of Artificial Sequence: Synthetic single chain variable fragment

SEQ ID NO: 6841 - protein, 242 aa, Artificial Sequence; identical to SEQ ID NO: 275
  Description of Artificial Sequence: Synthetic single chain variable fragment

SEQ ID NO: 6842 - protein, 245 aa, Artificial Sequence; identical to SEQ ID NO: 363
  Description of Artificial Sequence: Synthetic single chain variable fragment

SEQ ID NO: 6843 - protein, 119 aa, Artificial Sequence; identical to SEQ ID NO: 364
  Description of Artificial Sequence: Synthetic single chain variable fragment

SEQ ID NO: 6844 - protein, 438 aa, Artificial Sequence; identical to SEQ ID NO: 365
  Description of Artificial Sequence: Synthetic single chain variable fragment

SEQ ID NO: 6845 - protein, 272 aa, Artificial Sequence; identical to SEQ ID NO: 366
  Description of Artificial Sequence: Synthetic single chain variable fragment

SEQ ID NO: 6846 - protein, 267 aa, Artificial Sequence; identical to SEQ ID NO: 367
  Description of Artificial Sequence: Synthetic single chain variable fragment

SEQ ID NO: 6847 - protein, 270 aa, Artificial Sequence; identical to SEQ ID NO: 347
  Description of Artificial Sequence: Synthetic single chain variable fragment

SEQ ID NO: 6848 - protein, 277 aa, Artificial Sequence; identical to SEQ ID NO: 348
  Description of Artificial Sequence: Synthetic single chain variable fragment

SEQ ID NO: 6849 - protein, 242 aa, Artificial Sequence; identical to SEQ ID NO: 280
  Description of Artificial Sequence: Synthetic single chain variable fragment

SEQ ID NO: 6850 - protein, 242 aa, Artificial Sequence; identical to SEQ ID NO: 301
  Description of Artificial Sequence: Synthetic single chain variable fragment

SEQ ID NO: 6851 - protein, 242 aa, Artificial Sequence; identical to SEQ ID NO: 302
  Description of Artificial Sequence: Synthetic single chain variable fragment

SEQ ID NO: 6852 - protein, 247 aa, Artificial Sequence; identical to SEQ ID NO: 308
  Description of Artificial Sequence: Synthetic single chain variable fragment

SEQ ID NO: 6853 - protein, 247 aa, Artificial Sequence; identical to SEQ ID NO: 315
  Description of Artificial Sequence: Synthetic single chain variable fragment

SEQ ID NO: 6854 - protein, 247 aa, Artificial Sequence; identical to SEQ ID NO: 318
  Description of Artificial Sequence: Synthetic single chain variable fragment

SEQ ID NO: 6855 - protein, 247 aa, Artificial Sequence; identical to SEQ ID NO: 319
  Description of Artificial Sequence: Synthetic single chain variable fragment

SEQ ID NO: 6856 - protein, 247 aa, Artificial Sequence; identical to SEQ ID NO: 322
  Description of Artificial Sequence: Synthetic single chain variable fragment

SEQ ID NO: 6857 - protein, 247 aa, Artificial Sequence; identical to SEQ ID NO: 276
  Description of Artificial Sequence: Synthetic single chain variable fragment

SEQ ID NO: 6858 - protein, 242 aa, Artificial Sequence; identical to SEQ ID NO: 278
  Description of Artificial Sequence: Synthetic single chain variable fragment

SEQ ID NO: 6859 - protein, 495 aa, Artificial Sequence; identical to SEQ ID NO: 307
  Description of Artificial Sequence: Synthetic single chain variable fragment

SEQ ID NO: 6860 - protein, 242 aa, Artificial Sequence; identical to SEQ ID NO: 279
  Description of Artificial Sequence: Synthetic single chain variable fragment

SEQ ID NO: 6861 - protein, 242 aa, Artificial Sequence; identical to SEQ ID NO: 313
  Description of Artificial Sequence: Synthetic single chain variable fragment

SEQ ID NO: 6862 - protein, 252 aa, Artificial Sequence; identical to SEQ ID NO: 317
  Description of Artificial Sequence: Synthetic single chain variable fragment

SEQ ID NO: 6863 - protein, 250 aa, Artificial Sequence; identical to SEQ ID NO: 384
  Description of Artificial Sequence: Synthetic single chain variable fragment

SEQ ID NO: 6864 - protein, 242 aa, Artificial Sequence; identical to SEQ ID NO: 313
  Description of Artificial Sequence: Synthetic single chain variable fragment

SEQ ID NO: 6865 - protein, 251 aa, Artificial Sequence; identical to SEQ ID NO: 386
  Description of Artificial Sequence: Synthetic single chain variable fragment

SEQ ID NO: 6866 - protein, 271 aa, Artificial Sequence; identical to SEQ ID NO: 387
  Description of Artificial Sequence: Synthetic single chain variable fragment

SEQ ID NO: 6867 - protein, 248 aa, Artificial Sequence; identical to SEQ ID NO: 277
  Description of Artificial Sequence: Synthetic single chain variable fragment

SEQ ID NO: 6868 - protein, 246 aa, Artificial Sequence; identical to SEQ ID NO: 281
  Description of Artificial Sequence: Synthetic single chain variable fragment

SEQ ID NO: 6869 - protein, 252 aa, Artificial Sequence; identical to SEQ ID NO: 282
  Description of Artificial Sequence: Synthetic single chain variable fragment

SEQ ID NO: 6870 - protein, 249 aa, Artificial Sequence; identical to SEQ ID NO: 283
  Description of Artificial Sequence: Synthetic single chain variable fragment

SEQ ID NO: 6871 - protein, 251 aa, Artificial Sequence; identical to SEQ ID NO: 285
  Description of Artificial Sequence: Synthetic single chain variable fragment

SEQ ID NO: 6872 - protein, 252 aa, Artificial Sequence; identical to SEQ ID NO: 286
  Description of Artificial Sequence: Synthetic single chain variable fragment

SEQ ID NO: 6873 - protein, 249 aa, Artificial Sequence; identical to SEQ ID NO: 332
  Description of Artificial Sequence: Synthetic single chain variable fragment
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 6874 - protein, 252 aa, Artificial Sequence; identical to SEQ ID NO: 291
  Description of Artificial Sequence: Synthetic single chain variable fragment
  MOD_RES (76)..(76): Any amino acid
  MOD_RES (201)..(201): Any amino acid

SEQ ID NO: 6875 - protein, 250 aa, Artificial Sequence; identical to SEQ ID NO: 293
  Description of Artificial Sequence: Synthetic single chain variable fragment

SEQ ID NO: 6876 - protein, 252 aa, Artificial Sequence; identical to SEQ ID NO: 294
  Description of Artificial Sequence: Synthetic single chain variable fragment

SEQ ID NO: 6877 - protein, 236 aa, Artificial Sequence; identical to SEQ ID NO: 295
  Description of Artificial Sequence: Synthetic single chain variable fragment

SEQ ID NO: 6878 - protein, 251 aa, Artificial Sequence; identical to SEQ ID NO: 296
  Description of Artificial Sequence: Synthetic single chain variable fragment

SEQ ID NO: 6879 - protein, 246 aa, Artificial Sequence; identical to SEQ ID NO: 297
  Description of Artificial Sequence: Synthetic single chain variable fragment

SEQ ID NO: 6880 - protein, 239 aa, Artificial Sequence; identical to SEQ ID NO: 298
  Description of Artificial Sequence: Synthetic single chain variable fragment

SEQ ID NO: 6881 - protein, 250 aa, Artificial Sequence; identical to SEQ ID NO: 299
  Description of Artificial Sequence: Synthetic single chain variable fragment

SEQ ID NO: 6882 - protein, 251 aa, Artificial Sequence; identical to SEQ ID NO: 300
  Description of Artificial Sequence: Synthetic single chain variable fragment

SEQ ID NO: 6883 - protein, 246 aa, Artificial Sequence; identical to SEQ ID NO: 303
  Description of Artificial Sequence: Synthetic single chain variable fragment

SEQ ID NO: 6884 - protein, 249 aa, Artificial Sequence; identical to SEQ ID NO: 304
  Description of Artificial Sequence: Synthetic single chain variable fragment

SEQ ID NO: 6885 - protein, 249 aa, Artificial Sequence; identical to SEQ ID NO: 305
  Description of Artificial Sequence: Synthetic single chain variable fragment

SEQ ID NO: 6886 - protein, 252 aa, Artificial Sequence; identical to SEQ ID NO: 288
  Description of Artificial Sequence: Synthetic single chain variable fragment

SEQ ID NO: 6887 - protein, 251 aa, Artificial Sequence; identical to SEQ ID NO: 309
  Description of Artificial Sequence: Synthetic single chain variable fragment

SEQ ID NO: 6888 - protein, 250 aa, Artificial Sequence; identical to SEQ ID NO: 310
  Description of Artificial Sequence: Synthetic single chain variable fragment

SEQ ID NO: 6889 - protein, 247 aa, Artificial Sequence; identical to SEQ ID NO: 311
  Description of Artificial Sequence: Synthetic single chain variable fragment

SEQ ID NO: 6890 - protein, 248 aa, Artificial Sequence; identical to SEQ ID NO: 312
  Description of Artificial Sequence: Synthetic single chain variable fragment

SEQ ID NO: 6891 - protein, 251 aa, Artificial Sequence; identical to SEQ ID NO: 314
  Description of Artificial Sequence: Synthetic single chain variable fragment

SEQ ID NO: 6892 - protein, 250 aa, Artificial Sequence; identical to SEQ ID NO: 316
  Description of Artificial Sequence: Synthetic single chain variable fragment

SEQ ID NO: 6893 - protein, 249 aa, Artificial Sequence; identical to SEQ ID NO: 320
  Description of Artificial Sequence: Synthetic single chain variable fragment

SEQ ID NO: 6894 - protein, 251 aa, Artificial Sequence; identical to SEQ ID NO: 321
  Description of Artificial Sequence: Synthetic single chain variable fragment

SEQ ID NO: 6895 - protein, 249 aa, Artificial Sequence; identical to SEQ ID NO: 284
  Description of Artificial Sequence: Synthetic single chain variable fragment

SEQ ID NO: 6896 - protein, 277 aa, Artificial Sequence; identical to SEQ ID NO: 417
  Description of Artificial Sequence: Synthetic single chain variable fragment

SEQ ID NO: 6897 - protein, 242 aa, Artificial Sequence; identical to SEQ ID NO: 313
  Description of Artificial Sequence: Synthetic CD19 scFv

SEQ ID NO: 6898 - protein, 112 aa, Homo sapiens; identical to SEQ ID NO: 419

SEQ ID NO: 6899 - protein, 69 aa, Homo sapiens; identical to SEQ ID NO: 607

SEQ ID NO: 6900 - protein, 120 aa, Homo sapiens; identical to SEQ ID NO: 421

SEQ ID NO: 6901 - protein, 49 aa, Homo sapiens; identical to SEQ ID NO: 422

SEQ ID NO: 6902 - protein, 110 aa, Homo sapiens; identical to SEQ ID NO: 423

SEQ ID NO: 6903 - protein, 114 aa, Homo sapiens; identical to SEQ ID NO: 424

SEQ ID NO: 6904 - protein, 27 aa, Homo sapiens
FWVLVVVGGVLACYSLLVTVAFIIFWV

SEQ ID NO: 6905 - protein, 42 aa, Homo sapiens; identical to SEQ ID NO: 426

SEQ ID NO: 6906 - protein, 44 aa, Homo sapiens; identical to SEQ ID NO: 427

SEQ ID NO: 6907 - protein, 41 aa, Homo sapiens; identical to SEQ ID NO: 428

SEQ ID NO: 6908 - protein, 43 aa, Homo sapiens; identical to SEQ ID NO: 429

SEQ ID NO: 6909 - protein, 220 aa, Homo sapiens; identical to SEQ ID NO: 430

SEQ ID NO: 6910 - protein, 187 aa, Homo sapiens; identical to SEQ ID NO: 431

SEQ ID NO: 6911 - protein, 187 aa, Homo sapiens; identical to SEQ ID NO: 431

SEQ ID NO: 6912 - protein, 54 aa, Homo sapiens; identical to SEQ ID NO: 433

SEQ ID NO: 6913 - protein, 60 aa, Homo sapiens; identical to SEQ ID NO: 434

SEQ ID NO: 6914 - protein, 35 aa, Homo sapiens; identical to SEQ ID NO: 435

SEQ ID NO: 6915 - protein, 38 aa, Homo sapiens; identical to SEQ ID NO: 436

SEQ ID NO: 6916 - protein, 54 aa, Homo sapiens; identical to SEQ ID NO: 437

SEQ ID NO: 6917 - protein, 42 aa, Homo sapiens; identical to SEQ ID NO: 438

SEQ ID NO: 6918 - protein, 37 aa, Homo sapiens; identical to SEQ ID NO: 439

SEQ ID NO: 6919 - protein, 42 aa, Homo sapiens; identical to SEQ ID NO: 440

SEQ ID NO: 6920 - protein, 42 aa, Homo sapiens; identical to SEQ ID NO: 441

SEQ ID NO: 6921 - protein, 225 aa, Homo sapiens; identical to SEQ ID NO: 442

SEQ ID NO: 6922 - protein, 154 aa, Homo sapiens; identical to SEQ ID NO: 443

SEQ ID NO: 6923 - protein, 194 aa, Homo sapiens; identical to SEQ ID NO: 444

SEQ ID NO: 6924 - protein, 47 aa, Homo sapiens; identical to SEQ ID NO: 445

SEQ ID NO: 6925 - protein, 341 aa, Homo sapiens; identical to SEQ ID NO: 446

SEQ ID NO: 6926 - protein, 48 aa, Homo sapiens; identical to SEQ ID NO: 447

SEQ ID NO: 6927 - protein, 6 aa, Homo sapiens
FAAYRS

SEQ ID NO: 6928 - protein, 68 aa, Homo sapiens; identical to SEQ ID NO: 449

SEQ ID NO: 6929 - protein, 41 aa, Homo sapiens; identical to SEQ ID NO: 450

SEQ ID NO: 6930 - protein, 40 aa, Homo sapiens; identical to SEQ ID NO: 451

SEQ ID NO: 6931 - protein, 106 aa, Homo sapiens; identical to SEQ ID NO: 452

SEQ ID NO: 6932 - protein, 200 aa, Homo sapiens; identical to SEQ ID NO: 453

SEQ ID NO: 6933 - protein, 222 aa, Homo sapiens; identical to SEQ ID NO: 454

SEQ ID NO: 6934 - protein, 188 aa, Homo sapiens; identical to SEQ ID NO: 455

SEQ ID NO: 6935 - protein, 70 aa, Homo sapiens; identical to SEQ ID NO: 456

SEQ ID NO: 6936 - protein, 108 aa, Homo sapiens; identical to SEQ ID NO: 457

SEQ ID NO: 6937 - protein, 153 aa, Homo sapiens; identical to SEQ ID NO: 458

SEQ ID NO: 6938 - protein, 151 aa, Homo sapiens; identical to SEQ ID NO: 459

SEQ ID NO: 6939 - protein, 171 aa, Homo sapiens; identical to SEQ ID NO: 460

SEQ ID NO: 6940 - protein, 127 aa, Homo sapiens; identical to SEQ ID NO: 461

SEQ ID NO: 6941 - protein, 21 aa, Homo sapiens
DQVYQPLRDRDDAQYSHLGGN

SEQ ID NO: 6942 - protein, 171 aa, Homo sapiens; identical to SEQ ID NO: 460

SEQ ID NO: 6943 - protein, 127 aa, Homo sapiens; identical to SEQ ID NO: 461

SEQ ID NO: 6944 - protein, 21 aa, Homo sapiens
DQVYQPLRDRDDAQYSHLGGN

SEQ ID NO: 6945 - protein, 207 aa, Homo sapiens; identical to SEQ ID NO: 466

SEQ ID NO: 6946 - protein, 21 aa, Homo sapiens
NPDYEPIRKGQRDLYSGLNQR

SEQ ID NO: 6947 - protein, 182 aa, Homo sapiens; identical to SEQ ID NO: 468

SEQ ID NO: 6948 - protein, 21 aa, Homo sapiens
DQLYQPLKDREDDQYSHLQGN

SEQ ID NO: 6949 - protein, 21 aa, Homo sapiens
DQLYQPLKDREDDQYSHLQGN

SEQ ID NO: 6950 - protein, 182 aa, Homo sapiens; identical to SEQ ID NO: 468

SEQ ID NO: 6951 - protein, 163 aa, Homo sapiens; identical to SEQ ID NO: 472

SEQ ID NO: 6952 - protein, 164 aa, Homo sapiens; identical to SEQ ID NO: 473

SEQ ID NO: 6953 - protein, 164 aa, Homo sapiens; identical to SEQ ID NO: 473

SEQ ID NO: 6954 - protein, 21 aa, Homo sapiens
NQLYNELNLGRREEYDVLDKR

SEQ ID NO: 6955 - protein, 112 aa, Homo sapiens; identical to SEQ ID NO: 476

SEQ ID NO: 6956 - protein, 21 aa, Homo sapiens
DGLYQGLSTATKDTYDALHMQ

SEQ ID NO: 6957 - protein, 112 aa, Homo sapiens; identical to SEQ ID NO: 478

SEQ ID NO: 6958 - protein, 113 aa, Homo sapiens; identical to SEQ ID NO: 479

SEQ ID NO: 6959 - protein, 114 aa, Homo sapiens; identical to SEQ ID NO: 480

SEQ ID NO: 6960 - protein, 98 aa, Homo sapiens; identical to SEQ ID NO: 481

SEQ ID NO: 6961 - protein, 112 aa, Homo sapiens; identical to SEQ ID NO: 482

SEQ ID NO: 6962 - protein, 173 aa, Homo sapiens; identical to SEQ ID NO: 483

SEQ ID NO: 6963 - protein, 113 aa, Homo sapiens; identical to SEQ ID NO: 484

SEQ ID NO: 6964 - protein, 60 aa, Homo sapiens; identical to SEQ ID NO: 485

SEQ ID NO: 6965 - protein, 114 aa, Homo sapiens; identical to SEQ ID NO: 486

SEQ ID NO: 6966 - protein, 113 aa, Homo sapiens; identical to SEQ ID NO: 487

SEQ ID NO: 6967 - protein, 21 aa, Homo sapiens
NQLYNELNLGRREEYDVLDKR

SEQ ID NO: 6968 - protein, 22 aa, Homo sapiens
EGLYNELQKDKMAEAYSEIGMK

SEQ ID NO: 6969 - protein, 21 aa, Homo sapiens
DGLYQGLSTATKDTYDALHMQ

SEQ ID NO: 6970 - protein, 112 aa, Homo sapiens; identical to SEQ ID NO: 476

SEQ ID NO: 6971 - protein, 112 aa, Homo sapiens; identical to SEQ ID NO: 419

SEQ ID NO: 6972 - protein, 110 aa, Homo sapiens; identical to SEQ ID NO: 493

SEQ ID NO: 6973 - protein, 137 aa, Homo sapiens; identical to SEQ ID NO: 494

SEQ ID NO: 6974 - protein, 163 aa, Homo sapiens; identical to SEQ ID NO: 472

SEQ ID NO: 6975 - protein, 38 aa, Homo sapiens; identical to SEQ ID NO: 496

SEQ ID NO: 6976 - protein, 226 aa, Homo sapiens; identical to SEQ ID NO: 497

SEQ ID NO: 6977 - protein, 188 aa, Homo sapiens; identical to SEQ ID NO: 498

SEQ ID NO: 6978 - protein, 226 aa, Homo sapiens; identical to SEQ ID NO: 497

SEQ ID NO: 6979 - protein, 21 aa, Homo sapiens
ENLYEGLNLDDCSMYEDISRG

SEQ ID NO: 6980 - protein, 84 aa, Homo sapiens; identical to SEQ ID NO: 501

SEQ ID NO: 6981 - protein, 84 aa, Homo sapiens; identical to SEQ ID NO: 502

SEQ ID NO: 6982 - protein, 47 aa, Homo sapiens; identical to SEQ ID NO: 503

SEQ ID NO: 6983 - protein, 41 aa, Homo sapiens; identical to SEQ ID NO: 504

SEQ ID NO: 6984 - protein, 47 aa, Homo sapiens; identical to SEQ ID NO: 505

SEQ ID NO: 6985 - protein, 20 aa, Homo sapiens
RPRRSPAQDGKVYINMPGRG

SEQ ID NO: 6986 - protein, 113 aa, Homo sapiens; identical to SEQ ID NO: 507

SEQ ID NO: 6987 - protein, 112 aa, Homo sapiens; identical to SEQ ID NO: 508

SEQ ID NO: 6988 - protein, 102 aa, Homo sapiens; identical to SEQ ID NO: 509

SEQ ID NO: 6989 - protein, 101 aa, Homo sapiens; identical to SEQ ID NO: 510

SEQ ID NO: 6990 - protein, 113 aa, Homo sapiens; identical to SEQ ID NO: 507

SEQ ID NO: 6991 - protein, 112 aa, Homo sapiens; identical to SEQ ID NO: 508

SEQ ID NO: 6992 - protein, 102 aa, Homo sapiens; identical to SEQ ID NO: 509

SEQ ID NO: 6993 - protein, 101 aa, Homo sapiens; identical to SEQ ID NO: 510

SEQ ID NO: 6994 - protein, 21 aa, Homo sapiens
ESPYQELQGQRSDVYSDLNTQ

SEQ ID NO: 6995 - protein, 21 aa, Homo sapiens
ESPYQELQGQRSDVYSDLNTQ

SEQ ID NO: 6996 - protein, 49 aa, Homo sapiens; identical to SEQ ID NO: 517

SEQ ID NO: 6997 - protein, 35 aa, Homo sapiens; identical to SEQ ID NO: 518

SEQ ID NO: 6998 - protein, 39 aa, Homo sapiens; identical to SEQ ID NO: 519

SEQ ID NO: 6999 - protein, 149 aa, Homo sapiens; identical to SEQ ID NO: 520

SEQ ID NO: 7000 - protein, 619 aa, Homo sapiens; identical to SEQ ID NO: 521

SEQ ID NO: 7001 - protein, 180 aa, Homo sapiens; identical to SEQ ID NO: 522

SEQ ID NO: 7002 - protein, 240 aa, Homo sapiens; identical to SEQ ID NO: 523

SEQ ID NO: 7003 - protein, 86 aa, Homo sapiens; identical to SEQ ID NO: 524

SEQ ID NO: 7004 - protein, 21 aa, Homo sapiens
DGVYTGLSTRNQETYETLKHE

SEQ ID NO: 7005 - protein, 66 aa, Homo sapiens; identical to SEQ ID NO: 526

SEQ ID NO: 7006 - protein, 21 aa, Homo sapiens
DGVYTGLSTRNQETYETLKHE

SEQ ID NO: 7007 - protein, 46 aa, Homo sapiens; identical to SEQ ID NO: 528

SEQ ID NO: 7008 - protein, 31 aa, Homo sapiens; identical to SEQ ID NO: 529

SEQ ID NO: 7009 - protein, 27 aa, Homo sapiens
IISFFLALTSTALLFLLFFLTLRFSVV

SEQ ID NO: 7010 - protein, 26 aa, Homo sapiens
VAAILGLGLVLGLLGPLAILLALYLL

SEQ ID NO: 7011 - protein, 363 aa, Homo sapiens; identical to SEQ ID NO: 532

SEQ ID NO: 7012 - protein, 21 aa, Homo sapiens
AVFGCIFGALVIVTVGGFIFW

SEQ ID NO: 7013 - protein, 185 aa, Homo sapiens; identical to SEQ ID NO: 534

SEQ ID NO: 7014 - protein, 106 aa, Homo sapiens; identical to SEQ ID NO: 535

SEQ ID NO: 7015 - protein, 27 aa, Homo sapiens
FWVLVVVGGVLACYSLLVTVAFIIFWV

SEQ ID NO: 7016 - protein, 66 aa, Homo sapiens; identical to SEQ ID NO: 537

SEQ ID NO: 7017 - protein, 33 aa, Homo sapiens; identical to SEQ ID NO: 538

SEQ ID NO: 7018 - protein, 68 aa, Homo sapiens; identical to SEQ ID NO: 449

SEQ ID NO: 7019 - protein, 28 aa, Homo sapiens
MFWVLVVVGGVLACYSLLVTVAFIIFWV

SEQ ID NO: 7020 - protein, 26 aa, Homo sapiens
FWVLVVVGGVLACYSLLVTVAFHFWV

SEQ ID NO: 7021 - protein, 28 aa, Homo sapiens
MFWVLVVVGGVLACYSGGVTVAFIIFWV

SEQ ID NO: 7022 - protein, 26 aa, Homo sapiens
WVLVVVGGVLACYSLLVTVAFIIFWV

SEQ ID NO: 7023 - protein, 69 aa, Homo sapiens; identical to SEQ ID NO: 544

SEQ ID NO: 7024 - protein, 180 aa, Homo sapiens; identical to SEQ ID NO: 545

SEQ ID NO: 7025 - protein, 216 aa, Homo sapiens; identical to SEQ ID NO: 546

SEQ ID NO: 7026 - protein, 140 aa, Homo sapiens; identical to SEQ ID NO: 547

SEQ ID NO: 7027 - protein, 222 aa, Homo sapiens; identical to SEQ ID NO: 454

SEQ ID NO: 7028 - protein, 23 aa, Homo sapiens
LCYLLDGILFIYGVILTALFLRV

SEQ ID NO: 7029 - protein, 51 aa, Homo sapiens; identical to SEQ ID NO: 550

SEQ ID NO: 7030 - protein, 21 aa, Homo sapiens
LCYLLDGILFIYGVILTALFL

SEQ ID NO: 7031 - protein, 25 aa, Homo sapiens
ALIVLGGVAGLLLFIGLGIFFCVRC

SEQ ID NO: 7032 - protein, 22 aa, Homo sapiens
MALIVLGGVAGLLLFIGLGIFF

SEQ ID NO: 7033 - protein, 725 aa, Homo sapiens; identical to SEQ ID NO: 554

SEQ ID NO: 7034 - protein, 23 aa, Homo sapiens
PLFIPVAVMVTAFSGLAFIIWLA

SEQ ID NO: 7035 - protein, 24 aa, Homo sapiens
ALPAALAVISFLLGLGLGVACVLA

SEQ ID NO: 7036 - protein, 21 aa, Homo sapiens
MALPVTALLLPLALLLHAARP

SEQ ID NO: 7037 - protein, 286 aa, Homo sapiens; identical to SEQ ID NO: 558

SEQ ID NO: 7038 - protein, 226 aa, Homo sapiens; identical to SEQ ID NO: 559

SEQ ID NO: 7039 - protein, 83 aa, Homo sapiens; identical to SEQ ID NO: 560

SEQ ID NO: 7040 - protein, 22 aa, Homo sapiens
IWAPLAGTCGVLLLSLVITLYC

SEQ ID NO: 7041 - protein, 24 aa, Homo sapiens
IYIWAPLAGTCGVLLLSLVITLYC

SEQ ID NO: 7042 - protein, 25 aa, Homo sapiens
IYIWAPLAGTCGVLLLSLVITLYCR

SEQ ID NO: 7043 - protein, 71 aa, Homo sapiens; identical to SEQ ID NO: 564

SEQ ID NO: 7044 - protein, 25 aa, Homo sapiens
IYIWAPLAGTCGVLLLSLVITLVCR

SEQ ID NO: 7045 - protein, 21 aa, Homo sapiens
IYIWAPLAGTCGVLLLSLVIT

SEQ ID NO: 7046 - protein, 23 aa, Homo sapiens
IYIWAPLAGTCGVLLLSLVITLY

SEQ ID NO: 7047 - protein, 101 aa, Homo sapiens; identical to SEQ ID NO: 568

SEQ ID NO: 7048 - protein, 52 aa, Homo sapiens; identical to SEQ ID NO: 569

SEQ ID NO: 7049 - protein, 257 aa, Homo sapiens; identical to SEQ ID NO: 570

SEQ ID NO: 7050 - protein, 244 aa, Homo sapiens; identical to SEQ ID NO: 571

SEQ ID NO: 7051 - protein, 86 aa, Homo sapiens; identical to SEQ ID NO: 524

SEQ ID NO: 7052 - protein, 54 aa, Homo sapiens; identical to SEQ ID NO: 573

SEQ ID NO: 7053 - protein, 31 aa, Homo sapiens; identical to SEQ ID NO: 574

SEQ ID NO: 7054 - protein, 68 aa, Homo sapiens; identical to SEQ ID NO: 578

SEQ ID NO: 7055 - protein, 106 aa, Homo sapiens; identical to SEQ ID NO: 579

SEQ ID NO: 7056 - protein, 28 aa, Homo sapiens
FWVLVVVGGVLACYSLLVTVAFIIFWVR

SEQ ID NO: 7057 - protein, 73 aa, Homo sapiens; identical to SEQ ID NO: 581

SEQ ID NO: 7058 - protein, 23 aa, Homo sapiens
LGLLVAGVLVLLVSLGVAIHLCC

SEQ ID NO: 7059 - protein, 27 aa, Homo sapiens
ILLAGLVAADAVASLLIVGAVFLCARR

SEQ ID NO: 7060 - protein, 21 aa, Homo sapiens
FWLPIGCAAFVVVCILGCILI

SEQ ID NO: 7061 - protein, 233 aa, Homo sapiens; identical to SEQ ID NO: 585

SEQ ID NO: 7062 - protein, 21 aa, Homo sapiens
LLFLILGVLSLLLLVTGAFGF

SEQ ID NO: 7063 - protein, 21 aa, Homo sapiens
VAAILGLGLVLGLLGPLAILL

SEQ ID NO: 7064 - protein, 20 aa, Homo sapiens
VGWGGLLGSLVLLVWVLAVI

SEQ ID NO: 7065 - protein, 27 aa, Homo sapiens
FWALVVVAGVLFCYGLLVTVALCVIWT

SEQ ID NO: 7066 - protein, 5 aa, Homo sapiens
DKTHT

SEQ ID NO: 7067 - protein, 4 aa, Homo sapiens
CPPC

SEQ ID NO: 7068 - protein, 15 aa, Homo sapiens
CPEPKSCDTPPPCPR

SEQ ID NO: 7069 - protein, 12 aa, Homo sapiens
ELKTPLGDTTHT

SEQ ID NO: 7070 - protein, 10 aa, Homo sapiens
KSCDKTHTCP

SEQ ID NO: 7071 - protein, 7 aa, Homo sapiens
KCCVDCP

SEQ ID NO: 7072 - protein, 7 aa, Homo sapiens
KYGPPCP

SEQ ID NO: 7073 - protein, 16 aa, Homo sapiens
VEPKSPDKTHTCPPCP

SEQ ID NO: 7074 - protein, 16 aa, Homo sapiens
LDPKSSDKTHTCPPCP

SEQ ID NO: 7075 - protein, 39 aa, Homo sapiens; identical to SEQ ID NO: 599

SEQ ID NO: 7076 - protein, 12 aa, Homo sapiens
GGAVHTRGLDFA

SEQ ID NO: 7077 - protein, 45 aa, Homo sapiens; identical to SEQ ID NO: 601

SEQ ID NO: 7078 - protein, 48 aa, Homo sapiens; identical to SEQ ID NO: 602

SEQ ID NO: 7079 - protein, 45 aa, Homo sapiens; identical to SEQ ID NO: 601

SEQ ID NO: 7080 - protein, 45 aa, Homo sapiens; identical to SEQ ID NO: 601

SEQ ID NO: 7081 - protein, 79 aa, Homo sapiens; identical to SEQ ID NO: 605

SEQ ID NO: 7082 - protein, 51 aa, Homo sapiens; identical to SEQ ID NO: 606

SEQ ID NO: 7083 - protein, 69 aa, Homo sapiens; identical to SEQ ID NO: 607

SEQ ID NO: 7084 - protein, 44 aa, Homo sapiens; identical to SEQ ID NO: 608

SEQ ID NO: 7085 - protein, 47 aa, Homo sapiens; identical to SEQ ID NO: 609

SEQ ID NO: 7086 - protein, 11 aa, Homo sapiens
LDKTHTCPPCP

SEQ ID NO: 7087 - protein, 101 aa, Homo sapiens; identical to SEQ ID NO: 568

SEQ ID NO: 7088 - protein, 16 aa, Homo sapiens
GLAVSTISSFFPPGYQ

SEQ ID NO: 7089 - protein, 16 aa, Homo sapiens
GLAVSTISSFFPPGYQ

SEQ ID NO: 7090 - protein, 282 aa, Homo sapiens; identical to SEQ ID NO: 614

SEQ ID NO: 7091 - protein, 246 aa, Homo sapiens; identical to SEQ ID NO: 615

SEQ ID NO: 7092 - protein, 45 aa, Homo sapiens; identical to SEQ ID NO: 616

SEQ ID NO: 7093 - protein, 16 aa, Homo sapiens
LEPKSCDKTHTCPPCP

SEQ ID NO: 7094 - protein, 43 aa, Homo sapiens; identical to SEQ ID NO: 618

SEQ ID NO: 7095 - protein, 15 aa, Homo sapiens
EPKSCDKTHTCPPCP

SEQ ID NO: 7096 - protein, 16 aa, Homo sapiens
ELKTPLGDTHTCPRCP

SEQ ID NO: 7097 - protein, 15 aa, Homo sapiens
EPKSCDTPPPCPRCP

SEQ ID NO: 7098 - protein, 12 aa, Homo sapiens
ESKYGPPCPSCP

SEQ ID NO: 7099 - protein, 12 aa, Homo sapiens
ERKCCVECPPCP

SEQ ID NO: 7100 - protein, 229 aa, Homo sapiens; identical to SEQ ID NO: 624

SEQ ID NO: 7101 - protein, 119 aa, Homo sapiens; identical to SEQ ID NO: 625

SEQ ID NO: 7102 - protein, 282 aa, Homo sapiens; identical to SEQ ID NO: 614

SEQ ID NO: 7103 - protein, 281 aa, Homo sapiens; identical to SEQ ID NO: 627

SEQ ID NO: 7104 - protein, 283 aa, Homo sapiens; identical to SEQ ID NO: 628

SEQ ID NO: 7105 - protein, 58 aa, Homo sapiens; identical to SEQ ID NO: 629

SEQ ID NO: 7106 - protein, 282 aa, Homo sapiens; identical to SEQ ID NO: 614

SEQ ID NO: 7107 - protein, 282 aa, Homo sapiens; identical to SEQ ID NO: 614

SEQ ID NO: 7108 - protein, 282 aa, Homo sapiens; identical to SEQ ID NO: 614

SEQ ID NO: 7109 - protein, 282 aa, Homo sapiens; identical to SEQ ID NO: 614

SEQ ID NO: 7110 - protein, 234 aa, Homo sapiens; identical to SEQ ID NO: 634
  MOD_RES (91)..(91): Selenocysteine

SEQ ID NO: 7111 - protein, 234 aa, Homo sapiens; identical to SEQ ID NO: 635

SEQ ID NO: 7112 - protein, 20 aa, Homo sapiens
AEPKSPDKTHTCPPCPKDPK

SEQ ID NO: 7113 - protein, 15 aa, Homo sapiens
EPKSCDKTHTCPPCP

SEQ ID NO: 7114 - protein, 233 aa, Homo sapiens; identical to SEQ ID NO: 638

SEQ ID NO: 7115 - protein, 13 aa, Homo sapiens
SVFLFPPKPKDTL

SEQ ID NO: 7116 - protein, 231 aa, Homo sapiens; identical to SEQ ID NO: 640

SEQ ID NO: 7117 - protein, 235 aa, Homo sapiens; identical to SEQ ID NO: 641

SEQ ID NO: 7118 - protein, 223 aa, Homo sapiens; identical to SEQ ID NO: 642

SEQ ID NO: 7119 - protein, 235 aa, Homo sapiens; identical to SEQ ID NO: 643

SEQ ID NO: 7120 - protein, 12 aa, Homo sapiens
ERKCCVECPPCP

SEQ ID NO: 7121 - protein, 17 aa, Homo sapiens
ELKTPLGDTTHTCPRCP

SEQ ID NO: 7122 - protein, 61 aa, Homo sapiens; identical to SEQ ID NO: 646

SEQ ID NO: 7123 - protein, 230 aa, Homo sapiens; identical to SEQ ID NO: 647

SEQ ID NO: 7124 - protein, 230 aa, Homo sapiens; identical to SEQ ID NO: 648

SEQ ID NO: 7125 - protein, 12 aa, Homo sapiens
SPNMVPHAHHAQ

SEQ ID NO: 7126 - protein, 107 aa, Homo sapiens; identical to SEQ ID NO: 650

SEQ ID NO: 7127 - protein, 129 aa, Homo sapiens; identical to SEQ ID NO: 651

SEQ ID NO: 7128 - protein, 229 aa, Homo sapiens; identical to SEQ ID NO: 652

SEQ ID NO: 7129 - protein, 229 aa, Homo sapiens; identical to SEQ ID NO: 653

SEQ ID NO: 7130 - protein, 230 aa, Homo sapiens; identical to SEQ ID NO: 647

SEQ ID NO: 7131 - DNA, 36 bp, Homo sapiens; identical to SEQ ID NO: 655

SEQ ID NO: 7132 - protein, 12 aa, Homo sapiens
ESKYGPPCPPCP

SEQ ID NO: 7133 - protein, 119 aa, Homo sapiens; identical to SEQ ID NO: 625

SEQ ID NO: 7134 - protein, 229 aa, Homo sapiens; identical to SEQ ID NO: 624

SEQ ID NO: 7135 - protein, 229 aa, Homo sapiens; identical to SEQ ID NO: 624

SEQ ID NO: 7136 - protein, 12 aa, Homo sapiens
ESKYGPPCPPCP

SEQ ID NO: 7137 - protein, 9 aa, Homo sapiens
YGPPCPPCP

SEQ ID NO: 7138 - protein, 10 aa, Homo sapiens
KYGPPCPPCP

SEQ ID NO: 7139 - protein, 13 aa, Homo sapiens
EVVKYGPPCPPCP

SEQ ID NO: 7140 - protein, 229 aa, Homo sapiens; identical to SEQ ID NO: 664

SEQ ID NO: 7141 - protein, 22 aa, Homo sapiens
ESKYGPPCPPCPGGGSSGGGSG

SEQ ID NO: 7142 - protein, 231 aa, Homo sapiens; identical to SEQ ID NO: 666

SEQ ID NO: 7143 - protein, 231 aa, Homo sapiens; identical to SEQ ID NO: 667

SEQ ID NO: 7144 - protein, 231 aa, Homo sapiens; identical to SEQ ID NO: 640

SEQ ID NO: 7145 - protein, 486 aa, Artificial Sequence; identical to SEQ ID NO: 669
  Description of Artificial Sequence: Synthetic Construct

SEQ ID NO: 7146 - protein, 593 aa, Artificial Sequence; identical to SEQ ID NO: 670
  Description of Artificial Sequence: Synthetic Construct

SEQ ID NO: 7147 - protein, 644 aa, Artificial Sequence; identical to SEQ ID NO: 671
  Description of Artificial Sequence: Synthetic Construct

SEQ ID NO: 7148 - protein, 593 aa, Artificial Sequence; identical to SEQ ID NO: 672
  Description of Artificial Sequence: Synthetic Construct

SEQ ID NO: 7149 - protein, 644 aa, Artificial Sequence; identical to SEQ ID NO: 673
  Description of Artificial Sequence: Synthetic Construct

SEQ ID NO: 7150 - protein, 649 aa, Artificial Sequence; identical to SEQ ID NO: 674
  Description of Artificial Sequence: Synthetic Construct

SEQ ID NO: 7151 - protein, 598 aa, Artificial Sequence; identical to SEQ ID NO: 675
  Description of Artificial Sequence: Synthetic Construct

SEQ ID NO: 7152 - protein, 677 aa, Artificial Sequence; identical to SEQ ID NO: 676
  Description of Artificial Sequence: Synthetic Construct

SEQ ID NO: 7153 - protein, 677 aa, Artificial Sequence; identical to SEQ ID NO: 677
  Description of Artificial Sequence: Synthetic Construct

SEQ ID NO: 7154 - protein, 677 aa, Artificial Sequence; identical to SEQ ID NO: 678
  Description of Artificial Sequence: Synthetic Construct

SEQ ID NO: 7155 - protein, 677 aa, Artificial Sequence; identical to SEQ ID NO: 679
  Description of Artificial Sequence: Synthetic Construct

SEQ ID NO: 7156 - protein, 607 aa, Artificial Sequence; identical to SEQ ID NO: 680
  Description of Artificial Sequence: Synthetic Construct

SEQ ID NO: 7157 - protein, 658 aa, Artificial Sequence; identical to SEQ ID NO: 681
  Description of Artificial Sequence: Synthetic Construct

SEQ ID NO: 7158 - protein, 686 aa, Artificial Sequence; identical to SEQ ID NO: 682
  Description of Artificial Sequence: Synthetic Construct

SEQ ID NO: 7159 - protein, 686 aa, Artificial Sequence; identical to SEQ ID NO: 683
  Description of Artificial Sequence: Synthetic Construct

SEQ ID NO: 7160 - protein, 677 aa, Artificial Sequence; identical to SEQ ID NO: 676
  Description of Artificial Sequence: Synthetic Construct

SEQ ID NO: 7161 - protein, 488 aa, Artificial Sequence; identical to SEQ ID NO: 685
  Description of Artificial Sequence: Synthetic Construct

SEQ ID NO: 7162 - protein, 508 aa, Artificial Sequence; identical to SEQ ID NO: 686
  Description of Artificial Sequence: Synthetic Construct

SEQ ID NO: 7163 - protein, 497 aa, Artificial Sequence; identical to SEQ ID NO: 687
  Description of Artificial Sequence: Synthetic Construct

SEQ ID NO: 7164 - protein, 502 aa, Artificial Sequence; identical to SEQ ID NO: 688
  Description of Artificial Sequence: Synthetic Construct

SEQ ID NO: 7165 - protein, 486 aa, Artificial Sequence; identical to SEQ ID NO: 669
  Description of Artificial Sequence: Synthetic Construct

SEQ ID NO: 7166 - protein, 743 aa, Artificial Sequence; identical to SEQ ID NO: 690
  Description of Artificial Sequence: Synthetic Construct

SEQ ID NO: 7167 - protein, 885 aa, Artificial Sequence; identical to SEQ ID NO: 691
  Description of Artificial Sequence: Synthetic Construct

SEQ ID NO: 7168 - protein, 907 aa, Artificial Sequence; identical to SEQ ID NO: 692
  Description of Artificial Sequence: Synthetic Construct

SEQ ID NO: 7169 - protein, 903 aa, Artificial Sequence; identical to SEQ ID NO: 693
  Description of Artificial Sequence: Synthetic Construct

SEQ ID NO: 7170 - protein, 107 aa, Homo sapiens; identical to SEQ ID NO: 192

SEQ ID NO: 7171 - protein, 187 aa, Homo sapiens; identical to SEQ ID NO: 1

SEQ ID NO: 7172 - protein, 159 aa, Escherichia coli [sequence omitted]

SEQ ID NO: 7173 - protein, 327 aa, Homo sapiens; identical to SEQ ID NO: 195

SEQ ID NO: 7174 - protein, 189 aa, Homo sapiens; identical to SEQ ID NO: 196

SEQ ID NO: 7175 - protein, 260 aa, Homo sapiens; identical to SEQ ID NO: 197

SEQ ID NO: 7176 - protein, 231 aa, Homo sapiens; identical to SEQ ID NO: 198

SEQ ID NO: 7177 - protein, 114 aa, Homo sapiens; identical to SEQ ID NO: 718

SEQ ID NO: 7178 - protein, 267 aa, Homo sapiens; identical to SEQ ID NO: 719

SEQ ID NO: 7179 - protein, 234 aa, Homo sapiens; identical to SEQ ID NO: 720

SEQ ID NO: 7180 - protein, 231 aa, Homo sapiens; identical to SEQ ID NO: 721

SEQ ID NO: 7181 - protein, 353 aa, Homo sapiens; identical to SEQ ID NO: 722

SEQ ID NO: 7182 - protein, 61 aa, Homo sapiens; identical to SEQ ID NO: 723

SEQ ID NO: 7183 - protein, 237 aa, Homo sapiens; identical to SEQ ID NO: 724

SEQ ID NO: 7184 - protein, 175 aa, Homo sapiens; identical to SEQ ID NO: 725

SEQ ID NO: 7185 - protein, 65 aa, Homo sapiens; identical to SEQ ID NO: 726

SEQ ID NO: 7186 - protein, 134 aa, Artificial Sequence; identical to SEQ ID NO: 1856
  Description of Artificial Sequence: Synthetic polypeptide

SEQ ID NO: 7187 - protein, 303 aa, Artificial Sequence; identical to SEQ ID NO: 1858
  Description of Artificial Sequence: Synthetic polypeptide

SEQ ID NO: 7188 - protein, 143 aa, Artificial Sequence; identical to SEQ ID NO: 1860
  Description of Artificial Sequence: Synthetic polypeptide

SEQ ID NO: 7189 - protein, 389 aa, Artificial Sequence; identical to SEQ ID NO: 1862
  Description of Artificial Sequence: Synthetic polypeptide

SEQ ID NO: 7190 - protein, 577 aa, Artificial Sequence; identical to SEQ ID NO: 1864
  Description of Artificial Sequence: Synthetic polypeptide

SEQ ID NO: 7191 - protein, 555 aa, Artificial Sequence; identical to SEQ ID NO: 1949
  Description of Artificial Sequence: Synthetic polypeptide

SEQ ID NO: 7192 - protein, 504 aa, Artificial Sequence; identical to SEQ ID NO: 1951
  Description of Artificial Sequence: Synthetic polypeptide

SEQ ID NO: 7193 - protein, 395 aa, Artificial Sequence [sequence omitted]

SEQ ID NO: 7194 - protein, 555 aa, Artificial Sequence; identical to SEQ ID NO: 1955
  Description of Artificial Sequence: Synthetic polypeptide

SEQ ID NO: 7195 - protein, 583 aa, Artificial Sequence; identical to SEQ ID NO: 1957
  Description of Artificial Sequence: Synthetic polypeptide

SEQ ID NO: 7196 - protein, 583 aa, Artificial Sequence; identical to SEQ ID NO: 1959
  Description of Artificial Sequence: Synthetic polypeptide

SEQ ID NO: 7197 - protein, 583 aa, Artificial Sequence; identical to SEQ ID NO: 1961
  Description of Artificial Sequence: Synthetic construct

SEQ ID NO: 7198 - protein, 583 aa, Artificial Sequence; identical to SEQ ID NO: 1965
  Description of Artificial Sequence: Synthetic construct

SEQ ID NO: 7199 - protein, 403 aa, Artificial Sequence; identical to SEQ ID NO: 1969
  Description of Artificial Sequence: Synthetic construct

SEQ ID NO: 7200 - protein, 403 aa, Artificial Sequence; identical to SEQ ID NO: 1971
  Description of Artificial Sequence: Synthetic construct

SEQ ID NO: 7201 - protein, 371 aa, Artificial Sequence; identical to SEQ ID NO: 1973
  Description of Artificial Sequence: Synthetic construct

SEQ ID NO: 7202 - protein, 407 aa, Artificial Sequence; identical to SEQ ID NO: 1975
  Description of Artificial Sequence: Synthetic construct

SEQ ID NO: 7203 - protein, 397 aa, Artificial Sequence; identical to SEQ ID NO: 1977
  Description of Artificial Sequence: Synthetic construct

SEQ ID NO: 7204 - protein, 407 aa, Artificial Sequence; identical to SEQ ID NO: 1975
  Description of Artificial Sequence: Synthetic construct

SEQ ID NO: 7205 - protein, 371 aa, Artificial Sequence; identical to SEQ ID NO: 2140
  Description of Artificial Sequence: Synthetic construct

SEQ ID NO: 7206 - protein, 573 aa, Artificial Sequence; identical to SEQ ID NO: 1984
  Description of Artificial Sequence: Synthetic construct

SEQ ID NO: 7207 - protein, 414 aa, Artificial Sequence; identical to SEQ ID NO: 1986
  Description of Artificial Sequence: Synthetic construct

SEQ ID NO: 7208 - protein, 601 aa, Artificial Sequence; identical to SEQ ID NO: 1988
  Description of Artificial Sequence: Synthetic construct

SEQ ID NO: 7209 - protein, 601 aa, Artificial Sequence; identical to SEQ ID NO: 1990
  Description of Artificial Sequence: Synthetic construct

SEQ ID NO: 7210 - protein, 601 aa, Artificial Sequence; identical to SEQ ID NO: 1992
  Description of Artificial Sequence: Synthetic construct

SEQ ID NO: 7211 - protein, 601 aa, Artificial Sequence; identical to SEQ ID NO: 1994
  Description of Artificial Sequence: Synthetic construct

SEQ ID NO: 7212 - protein, 601 aa, Artificial Sequence; identical to SEQ ID NO: 1996
  Description of Artificial Sequence: Synthetic construct

SEQ ID NO: 7213 - protein, 601 aa, Artificial Sequence; identical to SEQ ID NO: 1998
  Description of Artificial Sequence: Synthetic construct

SEQ ID NO: 7214 - protein, 320 aa, Artificial Sequence; identical to SEQ ID NO: 2004
  Description of Artificial Sequence: Synthetic construct

SEQ ID NO: 7215 - protein, 134 aa, Artificial Sequence; identical to SEQ ID NO: 2025
  Description of Artificial Sequence: Synthetic construct

SEQ ID NO: 7216 - protein, 681 aa, Artificial Sequence; identical to SEQ ID NO: 2000
  Description of Artificial Sequence: Synthetic construct

SEQ ID NO: 7217 - protein, 652 aa, Artificial Sequence; identical to SEQ ID NO: 2002
  Description of Artificial Sequence: Synthetic construct

SEQ ID NO: 7218 - protein, 583 aa, Artificial Sequence; identical to SEQ ID NO: 1963
  Description of Artificial Sequence: Synthetic polypeptide

SEQ ID NO: 7219 - protein, 320 aa, Artificial Sequence; identical to SEQ ID NO: 2004
  Description of Artificial Sequence: Synthetic construct

SEQ ID NO: 7220 - protein, 134 aa, Artificial Sequence; identical to SEQ ID NO: 2025
  Description of Artificial Sequence: Synthetic construct

SEQ ID NO: 7221 - protein, 107 aa, Homo sapiens; identical to SEQ ID NO: 192

SEQ ID NO: 7222 - protein, 187 aa, Homo sapiens; identical to SEQ ID NO: 1

SEQ ID NO: 7223 - protein, 159 aa, Escherichia coli [sequence omitted]

SEQ ID NO: 7224 - protein, 327 aa, Homo sapiens; identical to SEQ ID NO: 195

SEQ ID NO: 7225 - protein, 189 aa, Homo sapiens; identical to SEQ ID NO: 196

SEQ ID NO: 7226 - protein, 260 aa, Homo sapiens; identical to SEQ ID NO: 197

SEQ ID NO: 7227 - protein, 231 aa, Homo sapiens; identical to SEQ ID NO: 198

SEQ ID NO: 7228 - protein, 306 aa, Homo sapiens; identical to SEQ ID NO: 734

SEQ ID NO: 7229 - protein, 197 aa, Homo sapiens; identical to SEQ ID NO: 735

SEQ ID NO: 7230 - protein, 652 aa, Artificial Sequence; identical to SEQ ID NO: 1821
  Description of Artificial Sequence: Synthetic construct

SEQ ID NO: 7231 - protein, 653 aa, Artificial Sequence; identical to SEQ ID NO: 1823
  Description of Artificial Sequence: Synthetic construct

SEQ ID NO: 7232 - protein, 656 aa, Artificial Sequence; identical to SEQ ID NO: 1825
  Description of Artificial Sequence: Synthetic construct

SEQ ID NO: 7233 - protein, 655 aa, Artificial Sequence; identical to SEQ ID NO: 1827
  Description of Artificial Sequence: Synthetic construct

SEQ ID NO: 7234 - protein, 651 aa, Artificial Sequence; identical to SEQ ID NO: 1829
  Description of Artificial Sequence: Synthetic construct

SEQ ID NO: 7235 - protein, 540 aa, Artificial Sequence; identical to SEQ ID NO: 1831
  Description of Artificial Sequence: Synthetic construct

SEQ ID NO: 7236 - protein, 710 aa, Artificial Sequence; identical to SEQ ID NO: 1833
  Description of Artificial Sequence: Synthetic construct

SEQ ID NO: 7237 - protein, 738 aa, Artificial Sequence; identical to SEQ ID NO: 1835
  Description of Artificial Sequence: Synthetic construct

SEQ ID NO: 7238 - protein, 659 aa, Artificial Sequence; identical to SEQ ID NO: 1837
  Description of Artificial Sequence: Synthetic construct

SEQ ID NO: 7239 - protein, 306 aa, Artificial Sequence; identical to SEQ ID NO: 1807
  Description of Artificial Sequence: Synthetic Payload

SEQ ID NO: 7240 - protein, 107 aa, Homo sapiens; identical to SEQ ID NO: 192

SEQ ID NO: 7241 - protein, 159 aa, Escherichia coli [sequence omitted]

SEQ ID NO: 7242 - protein, 187 aa, Homo sapiens; identical to SEQ ID NO: 1

SEQ ID NO: 7243 - protein, 327 aa, Homo sapiens; identical to SEQ ID NO: 195

SEQ ID NO: 7244 - protein, 189 aa, Homo sapiens; identical to SEQ ID NO: 196

SEQ ID NO: 7245 - protein, 260 aa, Homo sapiens; identical to SEQ ID NO: 197

SEQ ID NO: 7246 - protein, 231 aa, Homo sapiens; identical to SEQ ID NO: 198

SEQ ID NO: 7247 - protein, 766 aa, Homo sapiens; identical to SEQ ID NO: 1172

SEQ ID NO: 7248 - protein, 133 aa, Homo sapiens [sequence omitted]

SEQ ID NO: 7249 - protein, 415 aa, Homo sapiens; identical to SEQ ID NO: 744

SEQ ID NO: 7250 - protein, 431 aa, Homo sapiens; identical to SEQ ID NO: 745

SEQ ID NO: 7251 - protein, 430 aa, Artificial Sequence; identical to SEQ ID NO: 746
  Description of Artificial Sequence: Synthetic Payload

SEQ ID NO: 7252 - protein, 396 aa, Homo sapiens; identical to SEQ ID NO: 747

SEQ ID NO: 7253 - protein, 395 aa, Artificial Sequence; identical to SEQ ID NO: 748
  Description of Artificial Sequence: Synthetic Payload

SEQ ID NO: 7254 - protein, 119 aa, Artificial Sequence; identical to SEQ ID NO: 749
  Description of Artificial Sequence: Synthetic Antibody variable domain

SEQ ID NO: 7255 - protein, 118 aa, Artificial Sequence; identical to SEQ ID NO: 750
  Description of Artificial Sequence: Synthetic Antibody variable domain

SEQ ID NO: 7256 - protein, 118 aa, Artificial Sequence; identical to SEQ ID NO: 750
  Description of Artificial Sequence: Synthetic Antibody variable domain

SEQ ID NO: 7257 - protein, 120 aa, Artificial Sequence; identical to SEQ ID NO: 752
  Description of Artificial Sequence: Synthetic Antibody variable domain

SEQ ID NO: 7258 - protein, 119 aa, Artificial Sequence; identical to SEQ ID NO: 753
  Description of Artificial Sequence: Synthetic Antibody variable domain

SEQ ID NO: 7259 - protein, 119 aa, Artificial Sequence; identical to SEQ ID NO: 754
  Description of Artificial Sequence: Synthetic Antibody variable domain

SEQ ID NO: 7260 - protein, 117 aa, Artificial Sequence; identical to SEQ ID NO: 755
  Description of Artificial Sequence: Synthetic Antibody variable domain

SEQ ID NO: 7261 - protein, 119 aa, Artificial Sequence; identical to SEQ ID NO: 756
  Description of Artificial Sequence: Synthetic Antibody variable domain

SEQ ID NO: 7262 - protein, 112 aa, Artificial Sequence; identical to SEQ ID NO: 757
  Description of Artificial Sequence: Synthetic Antibody variable domain

SEQ ID NO: 7263 - protein, 111 aa, Artificial Sequence; identical to SEQ ID NO: 758
  Description of Artificial Sequence: Synthetic Antibody variable domain

SEQ ID NO: 7264 - protein, 112 aa, Artificial Sequence; identical to SEQ ID NO: 759
  Description of Artificial Sequence: Synthetic Antibody variable domain

SEQ ID NO: 7265 - protein, 107 aa, Artificial Sequence; identical to SEQ ID NO: 760
  Description of Artificial Sequence: Synthetic Antibody variable domain

SEQ ID NO: 7266 - protein, 112 aa, Artificial Sequence; identical to SEQ ID NO: 761
  Description of Artificial Sequence: Synthetic Antibody variable domain

SEQ ID NO: 7267 - protein, 111 aa, Artificial Sequence; identical to SEQ ID NO: 762
  Description of Artificial Sequence: Synthetic Antibody variable domain

SEQ ID NO: 7268 - protein, 112 aa, Artificial Sequence; identical to SEQ ID NO: 763
  Description of Artificial Sequence: Synthetic Antibody variable domain

SEQ ID NO: 7269 - protein, 107 aa, Artificial Sequence; identical to SEQ ID NO: 764
  Description of Artificial Sequence: Synthetic Antibody variable domain

SEQ ID NO: 7270 - protein, 246 aa, Artificial Sequence; identical to SEQ ID NO: 765
  Description of Artificial Sequence: Synthetic scFv

SEQ ID NO: 7271 - protein, 242 aa, Artificial Sequence; identical to SEQ ID NO: 768
  Description of Artificial Sequence: Synthetic scFv

SEQ ID NO: 7272 - protein, 248 aa, Artificial Sequence; identical to SEQ ID NO: 769
  Description of Artificial Sequence: Synthetic scFv

SEQ ID NO: 7273 - protein, 247 aa, Artificial Sequence; identical to SEQ ID NO: 770
  Description of Artificial Sequence: Synthetic scFv

SEQ ID NO: 7274 - protein, 246 aa, Artificial Sequence; identical to SEQ ID NO: 771
  Description of Artificial Sequence: Synthetic scFv

SEQ ID NO: 7275 - protein, 243 aa, Artificial Sequence; identical to SEQ ID NO: 772
  Description of Artificial Sequence: Synthetic scFv

SEQ ID NO: 7276 - protein, 107 aa, Artificial Sequence; identical to SEQ ID NO: 773
  Description of Artificial Sequence: Synthetic Antibody variable domain

SEQ ID NO: 7277 - protein, 108 aa, Artificial Sequence; identical to SEQ ID NO: 774
  Description of Artificial Sequence: Synthetic Antibody variable domain

SEQ ID NO: 7278 - protein, 124 aa, Artificial Sequence; identical to SEQ ID NO: 775
  Description of Artificial Sequence: Synthetic Antibody variable domain

SEQ ID NO: 7279 - protein, 122 aa, Artificial Sequence; identical to SEQ ID NO: 776
  Description of Artificial Sequence: Synthetic Antibody variable domain

SEQ ID NO: 7280 - protein, 122 aa, Artificial Sequence; identical to SEQ ID NO: 777
  Description of Artificial Sequence: Synthetic Antibody variable domain

SEQ ID NO: 7281 - protein, 236 aa, Artificial Sequence; identical to SEQ ID NO: 778
  Description of Artificial Sequence: Synthetic scFv

SEQ ID NO: 7282 - protein, 245 aa, Artificial Sequence; identical to SEQ ID NO: 779
  Description of Artificial Sequence: Synthetic scFv

SEQ ID NO: 7283 - protein, 245 aa, Artificial Sequence; identical to SEQ ID NO: 780
  Description of Artificial Sequence: Synthetic scFv

SEQ ID NO: 7284 - protein, 120 aa, Mus musculus; identical to SEQ ID NO: 781

SEQ ID NO: 7285 - protein, 119 aa, Artificial Sequence; identical to SEQ ID NO: 782
  Description of Artificial Sequence: Synthetic Antibody variable domain

SEQ ID NO: 7286 - protein, 122 aa, Artificial Sequence; identical to SEQ ID NO: 783
  Description of Artificial Sequence: Synthetic Antibody variable domain

SEQ ID NO: 7287 - protein, 117 aa, Artificial Sequence; identical to SEQ ID NO: 784
  Description of Artificial Sequence: Synthetic Antibody variable domain

SEQ ID NO: 7288 - protein, 107 aa, Mus musculus; identical to SEQ ID NO: 785

SEQ ID NO: 7289 - protein, 109 aa, Artificial Sequence; identical to SEQ ID NO: 786
  Description of Artificial Sequence: Synthetic Antibody variable domain

SEQ ID NO: 7290 - protein, 110 aa, Artificial Sequence; identical to SEQ ID NO: 787
  Description of Artificial Sequence: Synthetic Antibody variable domain

SEQ ID NO: 7291 - protein, 109 aa, Artificial Sequence; identical to SEQ ID NO: 788
  Description of Artificial Sequence: Synthetic Antibody variable domain

SEQ ID NO: 7292 - protein, 244 aa, Artificial Sequence; identical to SEQ ID NO: 789
  Description of Artificial Sequence: Synthetic scFv

SEQ ID NO: 7293 - protein, 244 aa, Artificial Sequence; identical to SEQ ID NO: 790
  Description of Artificial Sequence: Synthetic scFv

SEQ ID NO: 7294 - protein, 248 aa, Artificial Sequence; identical to SEQ ID NO: 791
  Description of Artificial Sequence: Synthetic scFv

SEQ ID NO: 7295 - protein, 242 aa, Artificial Sequence; identical to SEQ ID NO: 792
  Description of Artificial Sequence: Synthetic scFv

SEQ ID NO: 7296 - protein, 449 aa, Artificial Sequence; identical to SEQ ID NO: 793
  Description of Artificial Sequence: Synthetic Antibody variable domain

SEQ ID NO: 7297 - protein, 211 aa, Artificial Sequence; identical to SEQ ID NO: 794
  Description of Artificial Sequence: Synthetic Antibody variable domain

SEQ ID NO: 7298 - protein, 446 aa, Artificial Sequence; identical to SEQ ID NO: 795
  Description of Artificial Sequence: Synthetic Antibody variable domain

SEQ ID NO: 7299 - protein, 448 aa, Artificial Sequence; identical to SEQ ID NO: 796
  Description of Artificial Sequence: Synthetic Antibody variable domain

SEQ ID NO: 7300 - protein, 211 aa, Artificial Sequence; identical to SEQ ID NO: 797
  Description of Artificial Sequence: Synthetic Antibody variable domain

SEQ ID NO: 7301 - protein, 448 aa, Artificial Sequence; identical to SEQ ID NO: 798
  Description of Artificial Sequence: Synthetic Antibody variable domain

SEQ ID NO: 7302 - protein, 211 aa, Artificial Sequence; identical to SEQ ID NO: 799
  Description of Artificial Sequence: Synthetic Antibody variable domain

SEQ ID NO: 7303 - protein, 446 aa, Artificial Sequence; identical to SEQ ID NO: 800
  Description of Artificial Sequence: Synthetic Antibody variable domain

SEQ ID NO: 7304 - protein, 105 aa, Homo sapiens; identical to SEQ ID NO: 801

SEQ ID NO: 7305 - protein, 102 aa, Homo sapiens; identical to SEQ ID NO: 802

SEQ ID NO: 7306 - protein, 449 aa, Artificial Sequence; identical to SEQ ID NO: 793
  Description of Artificial Sequence: Synthetic Antibody variable domain

SEQ ID NO: 7307 - protein, 211 aa, Artificial Sequence; identical to SEQ ID NO: 794
  Description of Artificial Sequence: Synthetic Antibody variable domain

SEQ ID NO: 7308 - protein, 449 aa, Artificial Sequence; identical to SEQ ID NO: 805
  Description of Artificial Sequence: Synthetic Antibody variable domain

SEQ ID NO: 7309 - protein, 211 aa, Artificial Sequence; identical to SEQ ID NO: 806
  Description of Artificial Sequence: Synthetic Antibody variable domain

SEQ ID NO: 7310 - protein, 446 aa, Artificial Sequence; identical to SEQ ID NO: 795
  Description of Artificial Sequence: Synthetic Antibody variable domain

SEQ ID NO: 7311 - protein, 446 aa, Artificial Sequence; identical to SEQ ID NO: 800
  Description of Artificial Sequence: Synthetic Antibody variable domain

SEQ ID NO: 7312 - protein, 119 aa, Artificial Sequence; identical to SEQ ID NO: 809
  Description of Artificial Sequence: Synthetic Antibody variable domain

SEQ ID NO: 7313 - protein, 104 aa, Artificial Sequence; identical to SEQ ID NO: 810
  Description of Artificial Sequence: Synthetic Antibody variable domain

SEQ ID NO: 7314 - protein, 118 aa, Artificial Sequence; identical to SEQ ID NO: 811
  Description of Artificial Sequence: Synthetic Antibody variable domain

SEQ ID NO: 7315 - protein, 118 aa, Artificial Sequence; identical to SEQ ID NO: 812
  Description of Artificial Sequence: Synthetic Antibody variable domain

SEQ ID NO: 7316 - protein, 108 aa, Artificial Sequence; identical to SEQ ID NO: 813
  Description of Artificial Sequence: Synthetic Antibody variable domain

SEQ ID NO: 7317 - protein, 108 aa, Artificial Sequence; identical to SEQ ID NO: 814
  Description of Artificial Sequence: Synthetic Antibody variable domain

SEQ ID NO: 7318 - protein, 113 aa, Artificial Sequence; identical to SEQ ID NO: 815
  Description of Artificial Sequence: Synthetic Antibody variable domain

SEQ ID NO: 7319 - protein, 113 aa, Artificial Sequence; identical to SEQ ID NO: 816
  Description of Artificial Sequence: Synthetic Antibody variable domain

SEQ ID NO: 7320 - protein, 118 aa, Artificial Sequence; identical to SEQ ID NO: 811
  Description of Artificial Sequence: Synthetic Antibody variable domain

SEQ ID NO: 7321 - protein, 118 aa, Artificial Sequence; identical to SEQ ID NO: 812
  Description of Artificial Sequence: Synthetic Antibody variable domain

SEQ ID NO: 7322 - protein, 108 aa, Artificial Sequence; identical to SEQ ID NO: 813
  Description of Artificial Sequence: Synthetic Antibody variable domain

SEQ ID NO: 7323 - protein, 108 aa, Artificial Sequence; identical to SEQ ID NO: 814
  Description of Artificial Sequence: Synthetic Antibody variable domain

SEQ ID NO: 7324 - protein, 240 aa, Artificial Sequence; identical to SEQ ID NO: 821
  Description of Artificial Sequence: Synthetic Antibody variable domain

SEQ ID NO: 7325 - protein, 462 aa, Artificial Sequence; identical to SEQ ID NO: 822
  Description of Artificial Sequence: Synthetic Antibody variable domain

SEQ ID NO: 7326 - protein, 120 aa, Artificial Sequence; identical to SEQ ID NO: 823
  Description of Artificial Sequence: Synthetic Antibody variable domain

SEQ ID NO: 7327 - protein, 112 aa, Artificial Sequence; identical to SEQ ID NO: 824
  Description of Artificial Sequence: Synthetic Antibody variable domain

SEQ ID NO: 7328 - protein, 120 aa, Artificial Sequence; identical to SEQ ID NO: 825
  Description of Artificial Sequence: Synthetic Antibody variable domain

SEQ ID NO: 7329 - protein, 112 aa, Artificial Sequence; identical to SEQ ID NO: 826
  Description of Artificial Sequence: Synthetic Antibody variable domain

SEQ ID NO: 7330 - protein, 119 aa, Artificial Sequence; identical to SEQ ID NO: 827
  Description of Artificial Sequence: Synthetic Antibody variable domain

SEQ ID NO: 7331 - protein, 113 aa, Artificial Sequence; identical to SEQ ID NO: 828
  Description of Artificial Sequence: Synthetic Antibody variable domain

SEQ ID NO: 7332 - protein, 119 aa, Artificial Sequence; identical to SEQ ID NO: 829
  Description of Artificial Sequence: Synthetic Antibody variable domain

SEQ ID NO: 7333 - protein, 113 aa, Artificial Sequence; identical to SEQ ID NO: 830
  Description of Artificial Sequence: Synthetic Antibody variable domain

SEQ ID NO: 7334 - protein, 119 aa, Artificial Sequence; identical to SEQ ID NO: 831
  Description of Artificial Sequence: Synthetic Antibody variable domain

SEQ ID NO: 7335 - protein, 113 aa, Artificial Sequence; identical to SEQ ID NO: 832
  Description of Artificial Sequence: Synthetic Antibody variable domain

SEQ ID NO: 7336 - protein, 119 aa, Artificial Sequence; identical to SEQ ID NO: 833
  Description of Artificial Sequence: Synthetic Antibody variable domain

SEQ ID NO: 7337 - protein, 113 aa, Artificial Sequence; identical to SEQ ID NO: 834
  Description of Artificial Sequence: Synthetic Antibody variable domain

SEQ ID NO: 7338 - protein, 120 aa, Artificial Sequence; identical to SEQ ID NO: 835
  Description of Artificial Sequence: Synthetic Antibody variable domain

SEQ ID NO: 7339 - protein, 112 aa, Artificial Sequence; identical to SEQ ID NO: 836
  Description of Artificial Sequence: Synthetic Antibody variable domain

SEQ ID NO: 7340 - protein, 120 aa, Artificial Sequence; identical to SEQ ID NO: 837
  Description of Artificial Sequence: Synthetic Antibody variable domain

SEQ ID NO: 7341 - protein, 112 aa, Artificial Sequence; identical to SEQ ID NO: 838
  Description of Artificial Sequence: Synthetic Antibody variable domain

SEQ ID NO: 7342 - protein, 121 aa, Artificial Sequence; identical to SEQ ID NO: 839
  Description of Artificial Sequence: Synthetic Antibody variable domain

SEQ ID NO: 7343 - protein, 121 aa, Artificial Sequence; identical to SEQ ID NO: 840
  Description of Artificial Sequence: Synthetic Antibody variable domain

SEQ ID NO: 7344 - protein, 107 aa, Artificial Sequence; identical to SEQ ID NO: 4045
  Description of Artificial Sequence: Synthetic Antibody variable domain

SEQ ID NO: 7345 - protein, 119 aa, Artificial Sequence; identical to SEQ ID NO: 842
  Description of Artificial Sequence: Synthetic Antibody variable domain

SEQ ID NO: 7346 - protein, 113 aa, Artificial Sequence; identical to SEQ ID NO: 843
  Description of Artificial Sequence: Synthetic Antibody variable domain

SEQ ID NO: 7347 - protein, 240 aa, Artificial Sequence; identical to SEQ ID NO: 821
  Description of Artificial Sequence: Synthetic Antibody variable domain

SEQ ID NO: 7348 - protein, 462 aa, Artificial Sequence; identical to SEQ ID NO: 822
  Description of Artificial Sequence: Synthetic Antibody variable domain

SEQ ID NO: 7349 - protein, 239 aa, Artificial Sequence; identical to SEQ ID NO: 846
  Description of Artificial Sequence: Synthetic Antibody variable domain

SEQ ID NO: 7350 - protein, 595 aa, Artificial Sequence; identical to SEQ ID NO: 847
  Description of Artificial Sequence: Synthetic Antibody variable domain

SEQ ID NO: 7351 - protein, 105 aa, Homo sapiens; identical to SEQ ID NO: 801

SEQ ID NO: 7352 - protein, 102 aa, Homo sapiens; identical to SEQ ID NO: 802

SEQ ID NO: 7353 - protein, 569 aa, Homo sapiens; identical to SEQ ID NO: 850

SEQ ID NO: 7354 - protein, 219 aa, Homo sapiens; identical to SEQ ID NO: 851

SEQ ID NO: 7355 - protein, 240 aa, Artificial Sequence; identical to SEQ ID NO: 821
  Description of Artificial Sequence: Synthetic Antibody variable domain

SEQ ID NO: 7356 - protein, 462 aa, Artificial Sequence; identical to SEQ ID NO: 822
  Description of Artificial Sequence: Synthetic Antibody variable domain

SEQ ID NO: 7357 - protein, 113 aa, Artificial Sequence; identical to SEQ ID NO: 816
  Description of Artificial Sequence: Synthetic Antibody variable domain

SEQ ID NO: 7358 - protein, 113 aa, Artificial Sequence; identical to SEQ ID NO: 815
  Description of Artificial Sequence: Synthetic Antibody variable domain

SEQ ID NO: 7359 - protein, 240 aa, Artificial Sequence; identical to SEQ ID NO: 821
  Description of Artificial Sequence: Synthetic Antibody variable domain

SEQ ID NO: 7360 - protein, 462 aa, Artificial Sequence; identical to SEQ ID NO: 822
  Description of Artificial Sequence: Synthetic Antibody variable domain

SEQ ID NO: 7361 - protein, 137 aa, Mus musculus; identical to SEQ ID NO: 858

SEQ ID NO: 7362 - protein, 133 aa, Mus musculus; identical to SEQ ID NO: 859

SEQ ID NO: 7363 - protein, 112 aa, Artificial Sequence; identical to SEQ ID NO: 860
  Description of Artificial Sequence: Synthetic Antibody variable domain

SEQ ID NO: 7364 - protein, 119 aa, Artificial Sequence; identical to SEQ ID NO: 861
  Description of Artificial Sequence: Synthetic Antibody variable domain

SEQ ID NO: 7365 - protein, 112 aa, Mus musculus; identical to SEQ ID NO: 860

SEQ ID NO: 7366 - protein, 119 aa, Mus musculus; identical to SEQ ID NO: 861

SEQ ID NO: 7367 - protein, 112 aa, Mus musculus; identical to SEQ ID NO: 864

SEQ ID NO: 7368 - protein, 119 aa, Mus musculus; identical to SEQ ID NO: 861

SEQ ID NO: 7369 - protein, 112 aa, Artificial Sequence; identical to SEQ ID NO: 860
  Description of Artificial Sequence: Synthetic Antibody variable domain

SEQ ID NO: 7370 - protein, 119 aa, Artificial Sequence; identical to SEQ ID NO: 861
  Description of Artificial Sequence: Synthetic Antibody variable domain

SEQ ID NO: 7371 - protein, 115 aa, Artificial Sequence; identical to SEQ ID NO: 868
  Description of Artificial Sequence: Synthetic Antibody variable domain

SEQ ID NO: 7372 - protein, 108 aa, Artificial Sequence; identical to SEQ ID NO: 869
  Description of Artificial Sequence: Synthetic Antibody variable domain

SEQ ID NO: 7373 - protein, 115 aa, Artificial Sequence; identical to SEQ ID NO: 870
  Description of Artificial Sequence: Synthetic Antibody variable domain

SEQ ID NO: 7374 - protein, 111 aa, Artificial Sequence; identical to SEQ ID NO: 871
  Description of Artificial Sequence: Synthetic Antibody variable domain

SEQ ID NO: 7375 - protein, 518 aa, Artificial Sequence; identical to SEQ ID NO: 872
  Description of Artificial Sequence: Synthetic scFv

SEQ ID NO: 7376 - protein, 524 aa, Artificial Sequence; identical to SEQ ID NO: 873
  Description of Artificial Sequence: Synthetic scFv

SEQ ID NO: 7377 - protein, 248 aa, Artificial Sequence; identical to SEQ ID NO: 874
  Description of Artificial Sequence: Synthetic scFv

SEQ ID NO: 7378 - protein, 225 aa, Artificial Sequence; identical to SEQ ID NO: 875
  Description of Artificial Sequence: Synthetic scFv

SEQ ID NO: 7379 - protein, 244 aa, Artificial Sequence; identical to SEQ ID NO: 876
  Description of Artificial Sequence: Synthetic scFv

SEQ ID NO: 7380 - protein, 230 aa, Artificial Sequence; identical to SEQ ID NO: 877
  Description of Artificial Sequence: Synthetic scFv

SEQ ID NO: 7381 - protein, 241 aa, Artificial Sequence; identical to SEQ ID NO: 878
  Description of Artificial Sequence: Synthetic scFv

SEQ ID NO: 7382 - protein, 249 aa, Artificial Sequence; identical to SEQ ID NO: 879
  Description of Artificial Sequence: Synthetic scFv

SEQ ID NO: 7383 - protein, 244 aa, Artificial Sequence; identical to SEQ ID NO: 880
  Description of Artificial Sequence: Synthetic scFv

SEQ ID NO: 7384 - protein, 243 aa, Artificial Sequence; identical to SEQ ID NO: 881
  Description of Artificial Sequence: Synthetic scFv

SEQ ID NO: 7385 - protein, 241 aa, Artificial Sequence; identical to SEQ ID NO: 882
  Description of Artificial Sequence: Synthetic scFv

SEQ ID NO: 7386 - protein, 239 aa, Artificial Sequence; identical to SEQ ID NO: 883
  Description of Artificial Sequence: Synthetic scFv

SEQ ID NO: 7387 - protein, 239 aa, Artificial Sequence; identical to SEQ ID NO: 884
  Description of Artificial Sequence: Synthetic scFv

SEQ ID NO: 7388 - protein, 239 aa, Artificial Sequence; identical to SEQ ID NO: 885
  Description of Artificial Sequence: Synthetic scFv

SEQ ID NO: 7389 - protein, 239 aa, Artificial Sequence; identical to SEQ ID NO: 886
  Description of Artificial Sequence: Synthetic scFv

SEQ ID NO: 7390 - protein, 239 aa, Artificial Sequence; identical to SEQ ID NO: 887
  Description of Artificial Sequence: Synthetic scFv

SEQ ID NO: 7391 - protein, 239 aa, Artificial Sequence; identical to SEQ ID NO: 888
  Description of Artificial Sequence: Synthetic scFv

SEQ ID NO: 7392 - protein, 239 aa, Artificial Sequence; identical to SEQ ID NO: 889
  Description of Artificial Sequence: Synthetic scFv

SEQ ID NO: 7393 - protein, 239 aa, Artificial Sequence; identical to SEQ ID NO: 890
  Description of Artificial Sequence: Synthetic scFv

SEQ ID NO: 7394 - protein, 239 aa, Artificial Sequence; identical to SEQ ID NO: 891
  Description of Artificial Sequence: Synthetic scFv

SEQ ID NO: 7395 - protein, 239 aa, Artificial Sequence; identical to SEQ ID NO: 892
  Description of Artificial Sequence: Synthetic scFv

SEQ ID NO: 7396 - protein, 239 aa, Artificial Sequence; identical to SEQ ID NO: 893
  Description of Artificial Sequence: Synthetic scFv

SEQ ID NO: 7397 - protein, 239 aa, Artificial Sequence; identical to SEQ ID NO: 894
  Description of Artificial Sequence: Synthetic scFv

SEQ ID NO: 7398 - protein, 239 aa, Artificial Sequence; identical to SEQ ID NO: 895
  Description of Artificial Sequence: Synthetic scFv

SEQ ID NO: 7399 - protein, 239 aa, Artificial Sequence; identical to SEQ ID NO: 896
  Description of Artificial Sequence: Synthetic scFv

SEQ ID NO: 7400 - protein, 100 aa, Artificial Sequence; identical to SEQ ID NO: 897
  Description of Artificial Sequence: Synthetic scFv

SEQ ID NO: 7401 - protein, 139 aa, Artificial Sequence; identical to SEQ ID NO: 898
  Description of Artificial Sequence: Synthetic scFv

SEQ ID NO: 7402 - protein, 243 aa, Artificial Sequence; identical to SEQ ID NO: 899
  Description of Artificial Sequence: Synthetic scFv

SEQ ID NO: 7403 - protein, 242 aa, Artificial Sequence; identical to SEQ ID NO: 900
  Description of Artificial Sequence: Synthetic scFv

SEQ ID NO: 7404 - protein, 115 aa, Artificial Sequence; identical to SEQ ID NO: 901
  Description of Artificial Sequence: Synthetic Antibody variable domain

SEQ ID NO: 7405 - protein, 111 aa, Artificial Sequence; identical to SEQ ID NO: 902
  Description of Artificial Sequence: Synthetic Antibody variable domain

SEQ ID NO: 7406 - protein, 117 aa, Artificial Sequence; identical to SEQ ID NO: 903
  Description of Artificial Sequence: Synthetic Antibody variable domain

SEQ ID NO: 7407 - protein, 228 aa, Artificial Sequence; identical to SEQ ID NO: 904
  Description of Artificial Sequence: Synthetic Antibody variable domain

SEQ ID NO: 7408 - protein, 120 aa, Artificial Sequence; identical to SEQ ID NO: 905
  Description of Artificial Sequence: Synthetic Antibody variable domain

SEQ ID NO: 7409 - protein, 115 aa, Artificial Sequence; identical to SEQ ID NO: 906
  Description of Artificial Sequence: Synthetic Antibody variable domain

SEQ ID NO: 7410 - protein, 118 aa, Artificial Sequence; identical to SEQ ID NO: 907
  Description of Artificial Sequence: Synthetic Antibody variable domain

SEQ ID NO: 7411 - protein, 113 aa, Artificial Sequence; identical to SEQ ID NO: 908
  Description of Artificial Sequence: Synthetic Antibody variable domain

SEQ ID NO: 7412 - protein, 119 aa, Artificial Sequence; identical to SEQ ID NO: 909
  Description of Artificial Sequence: Synthetic Antibody variable domain

SEQ ID NO: 7413 - protein, 112 aa, Artificial Sequence; identical to SEQ ID NO: 910
  Description of Artificial Sequence: Synthetic Antibody variable domain

SEQ ID NO: 7414 - protein, 119 aa, Artificial Sequence; identical to SEQ ID NO: 911
  Description of Artificial Sequence: Synthetic Antibody variable domain

SEQ ID NO: 7415 - protein, 112 aa, Artificial Sequence; identical to SEQ ID NO: 912
  Description of Artificial Sequence: Synthetic Antibody variable domain

SEQ ID NO: 7416 - protein, 117 aa, Artificial Sequence; identical to SEQ ID NO: 913
  Description of Artificial Sequence: Synthetic Antibody variable domain

SEQ ID NO: 7417 - protein, 111 aa, Artificial Sequence; identical to SEQ ID NO: 914
  Description of Artificial Sequence: Synthetic Antibody variable domain

SEQ ID NO: 7418 - protein, 117 aa, Artificial Sequence; identical to SEQ ID NO: 915
  Description of Artificial Sequence: Synthetic Antibody variable domain

SEQ ID NO: 7419 - protein, 111 aa, Artificial Sequence; identical to SEQ ID NO: 916
  Description of Artificial Sequence: Synthetic Antibody variable domain

SEQ ID NO: 7420 - protein, 120 aa, Artificial Sequence [sequence omitted]

SEQ ID NO: 7421 - protein, 107 aa, Artificial Sequence [sequence omitted]

SEQ ID NO: 7422 - protein, 109 aa, Artificial Sequence; identical to SEQ ID NO: 919
  Description of Artificial Sequence: Synthetic Antibody variable domain

SEQ ID NO: 7423 - protein, 120 aa, Artificial Sequence; identical to SEQ ID NO: 920
  Description of Artificial Sequence: Synthetic Antibody variable domain

SEQ ID NO: 7424 - protein, 109 aa, Artificial Sequence; identical to SEQ ID NO: 921
  Description of Artificial Sequence: Synthetic Antibody variable domain

SEQ ID NO: 7425 - protein, 120 aa, Artificial Sequence; identical to SEQ ID NO: 922
  Description of Artificial Sequence: Synthetic Antibody variable domain

SEQ ID NO: 7426 - protein, 109 aa, Artificial Sequence; identical to SEQ ID NO: 923
  Description of Artificial Sequence: Synthetic Antibody variable domain

SEQ ID NO: 7427 - protein, 120 aa, Artificial Sequence; identical to SEQ ID NO: 924
  Description of Artificial Sequence: Synthetic Antibody variable domain

SEQ ID NO: 7428 - protein, 20 aa, Artificial Sequence
  Description of Artificial Sequence: Synthetic Antibody variable domain
EVQLVESGGGLVQPKGSLKL

SEQ ID NO: 7429 - protein, 20 aa, Artificial Sequence
  Description of Artificial Sequence: Synthetic Antibody variable domain
DIVMTQSQKFMSTSVVDRIS

SEQ ID NO: 7430 - protein, 107 aa, Mus musculus; identical to SEQ ID NO: 927

SEQ ID NO: 7431 - protein, 119 aa, Mus musculus; identical to SEQ ID NO: 928

SEQ ID NO: 7432 - protein, 107 aa, Artificial Sequence [sequence omitted]

SEQ ID NO: 7433 - protein, 119 aa, Artificial Sequence [sequence omitted]

SEQ ID NO: 7434 - protein, 107 aa, Artificial Sequence; identical to SEQ ID NO: 931
  Description of Artificial Sequence: Synthetic Antibody variable domain

SEQ ID NO: 7435 - protein, 119 aa, Artificial Sequence; identical to SEQ ID NO: 932
  Description of Artificial Sequence: Synthetic Antibody variable domain

SEQ ID NO: 7436 - protein, 214 aa, Artificial Sequence; identical to SEQ ID NO: 933
  Description of Artificial Sequence: Synthetic Antibody variable domain

SEQ ID NO: 7437 - protein, 448 aa, Artificial Sequence; identical to SEQ ID NO: 934
  Description of Artificial Sequence: Synthetic Antibody variable domain

SEQ ID NO: 7438 - protein, 214 aa, Artificial Sequence; identical to SEQ ID NO: 935
  Description of Artificial Sequence: Synthetic Antibody variable domain

SEQ ID NO: 7439 - protein, 449 aa, Artificial Sequence; identical to SEQ ID NO: 936
  Description of Artificial Sequence: Synthetic Antibody variable domain

SEQ ID NO: 7440 - protein, 217 aa, Artificial Sequence; identical to SEQ ID NO: 937
  Description of Artificial Sequence: Synthetic Antibody variable domain

SEQ ID NO: 7441 - protein, 449 aa, Artificial Sequence; identical to SEQ ID NO: 938
  Description of Artificial Sequence: Synthetic Antibody variable domain

SEQ ID NO: 7442 - protein, 124 aa, Homo sapiens; identical to SEQ ID NO: 939

SEQ ID NO: 7443 - protein, 107 aa, Homo sapiens; identical to SEQ ID NO: 940

SEQ ID NO: 7444 - protein, 122 aa, Homo sapiens; identical to SEQ ID NO: 941

SEQ ID NO: 7445 - protein, 107 aa, Homo sapiens; identical to SEQ ID NO: 942

SEQ ID NO: 7446 - protein, 122 aa, Homo sapiens; identical to SEQ ID NO: 943

SEQ ID NO: 7447 - protein, 108 aa, Homo sapiens; identical to SEQ ID NO: 944

SEQ ID NO: 7448 - protein, 109 aa, Artificial Sequence; identical to SEQ ID NO: 945
  Description of Artificial Sequence: Synthetic Antibody variable domain

SEQ ID NO: 7449 - protein, 109 aa, Artificial Sequence; identical to SEQ ID NO: 946
  Description of Artificial Sequence: Synthetic Antibody variable domain

SEQ ID NO: 7450 - protein, 109 aa, Artificial Sequence; identical to SEQ ID NO: 947
  Description of Artificial Sequence: Synthetic Antibody variable domain

SEQ ID NO: 7451 - protein, 228 aa, Artificial Sequence; identical to SEQ ID NO: 948
  Description of Artificial Sequence: Synthetic Antibody variable domain

SEQ ID NO: 7452 - protein, 109 aa, Homo sapiens; identical to SEQ ID NO: 949

SEQ ID NO: 7453 - protein, 142 aa, Artificial Sequence; identical to SEQ ID NO: 950
  Description of Artificial Sequence: Synthetic Antibody variable domain

SEQ ID NO: 7454 - protein, 130 aa, Artificial Sequence; identical to SEQ ID NO: 951
  Description of Artificial Sequence: Synthetic Antibody variable domain

SEQ ID NO: 7455 - protein, 472 aa, Artificial Sequence; identical to SEQ ID NO: 952
  Description of Artificial Sequence: Synthetic Antibody variable domain

SEQ ID NO: 7456 - protein, 236 aa, Artificial Sequence; identical to SEQ ID NO: 953
  Description of Artificial Sequence: Synthetic Antibody variable domain

SEQ ID NO: 7457 - protein, 628 aa, Artificial Sequence; identical to SEQ ID NO: 954
  Description of Artificial Sequence: Synthetic Antibody variable domain

SEQ ID NO: 7458 - protein, 643 aa, Artificial Sequence; identical to SEQ ID NO: 955
  Description of Artificial Sequence: Synthetic Antibody variable domain

SEQ ID NO: 7459 - protein, 214 aa, Mus musculus; identical to SEQ ID NO: 956

SEQ ID NO: 7460 - protein, 220 aa, Mus musculus; identical to SEQ ID NO: 957

SEQ ID NO: 7461 - protein, 233 aa, Artificial Sequence; identical to SEQ ID NO: 958
  Description of Artificial Sequence: Synthetic Antibody variable domain

SEQ ID NO: 7462 - protein, 467 aa, Artificial Sequence; identical to SEQ ID NO: 959
  Description of Artificial Sequence: Synthetic Antibody variable domain

SEQ ID NO: 7463 - protein, 219 aa, Artificial Sequence; identical to SEQ ID NO: 960
  Description of Artificial Sequence: Synthetic Antibody variable domain

SEQ ID NO: 7464 - protein, 234 aa, Artificial Sequence; identical to SEQ ID NO: 961
  Description of Artificial Sequence: Synthetic Antibody variable domain

SEQ ID NO: 7465 - protein, 450 aa, Artificial Sequence; identical to SEQ ID NO: 962
  Description of Artificial Sequence: Synthetic Antibody variable domain

SEQ ID NO: 7466 - protein, 450 aa, Artificial Sequence; identical to SEQ ID NO: 963
  Description of Artificial Sequence: Synthetic Antibody variable domain

SEQ ID NO: 7467 - protein, 214 aa, Artificial Sequence; identical to SEQ ID NO: 964
  Description of Artificial Sequence: Synthetic Antibody variable domain

SEQ ID NO: 7468 - protein, 129 aa, Artificial Sequence; identical to SEQ ID NO: 965
  Description of Artificial Sequence: Synthetic Antibody variable domain

SEQ ID NO: 7469 - protein, 111 aa, Artificial Sequence; identical to SEQ ID NO: 966
  Description of Artificial Sequence: Synthetic Antibody variable domain

SEQ ID NO: 7470 - protein, 121 aa, Artificial Sequence; identical to SEQ ID NO: 967
  Description of Artificial Sequence: Synthetic Antibody variable domain

SEQ ID NO: 7471 - protein, 107 aa, Artificial Sequence; identical to SEQ ID NO: 968
  Description of Artificial Sequence: Synthetic Antibody variable domain

SEQ ID NO: 7472 - protein, 451 aa, Artificial Sequence; identical to SEQ ID NO: 969
  Description of Artificial Sequence: Synthetic Antibody variable domain

SEQ ID NO: 7473 - protein, 469 aa, Artificial Sequence; identical to SEQ ID NO: 970
  Description of Artificial Sequence: Synthetic Antibody variable domain

SEQ ID NO: 7474 - protein, 233 aa, Artificial Sequence; identical to SEQ ID NO: 971
  Description of Artificial Sequence: Synthetic Antibody variable domain

SEQ ID NO: 7475 - protein, 450 aa, Artificial Sequence; identical to SEQ ID NO: 972
  Description of Artificial Sequence: Synthetic Antibody variable domain

SEQ ID NO: 7476 - protein, 263 aa, Artificial Sequence; identical to SEQ ID NO: 973
  Description of Artificial Sequence: Synthetic scFv

SEQ ID NO: 7477 - protein, 242 aa, Artificial Sequence; identical to SEQ ID NO: 974
  Description of Artificial Sequence: Synthetic scFv

SEQ ID NO: 7478 - protein, 477 aa, Artificial Sequence; identical to SEQ ID NO: 975
  Description of Artificial Sequence: Synthetic scFv

SEQ ID NO: 7479 - protein, 291 aa, Artificial Sequence; identical to SEQ ID NO: 976
  Description of Artificial Sequence: Synthetic scFv

SEQ ID NO: 7480 - protein, 291 aa, Artificial Sequence; identical to SEQ ID NO: 977
  Description of Artificial Sequence: Synthetic scFv

SEQ ID NO: 7481 - protein, 665 aa, Artificial Sequence; identical to SEQ ID NO: 978
  Description of Artificial Sequence: Synthetic scFv

SEQ ID NO: 7482 - protein, 278 aa, Artificial Sequence; identical to SEQ ID NO: 979
  Description of Artificial Sequence: Synthetic scFv

SEQ ID NO: 7483 - protein, 280 aa, Artificial Sequence; identical to SEQ ID NO: 980
  Description of Artificial Sequence: Synthetic scFv

SEQ ID NO: 7484 - protein, 114 aa, Homo sapiens; identical to SEQ ID NO: 480

SEQ ID NO: 7485 - protein, 98 aa, Homo sapiens; identical to SEQ ID NO: 481

SEQ ID NO: 7486 - protein, 112 aa, Homo sapiens; identical to SEQ ID NO: 482

SEQ ID NO: 7487 - protein, 173 aa, Homo sapiens; identical to SEQ ID NO: 483

SEQ ID NO: 7488 - protein, 113 aa, Homo sapiens; identical to SEQ ID NO: 484

SEQ ID NO: 7489 - protein, 60 aa, Homo sapiens; identical to SEQ ID NO: 485

SEQ ID NO: 7490 - protein, 114 aa, Homo sapiens; identical to SEQ ID NO: 486

SEQ ID NO: 7491 - protein, 113 aa, Homo sapiens; identical to SEQ ID NO: 487

SEQ ID NO: 7492 - protein, 22 aa, Homo sapiens
EGLYNELQKDKMAEAYSEIGMK

SEQ ID NO: 7493 - protein, 112 aa, Homo sapiens; identical to SEQ ID NO: 419

SEQ ID NO: 7494 - protein, 110 aa, Homo sapiens; identical to SEQ ID NO: 493

SEQ ID NO: 7495 - protein, 137 aa, Homo sapiens; identical to SEQ ID NO: 494

SEQ ID NO: 7496 - protein, 163 aa, Homo sapiens; identical to SEQ ID NO: 472

SEQ ID NO: 7497 - protein, 38 aa, Homo sapiens; identical to SEQ ID NO: 496

SEQ ID NO: 7498 - protein, 226 aa, Homo sapiens; identical to SEQ ID NO: 497

SEQ ID NO: 7499 - protein, 188 aa, Homo sapiens; identical to SEQ ID NO: 498

SEQ ID NO: 7500 - protein, 21 aa, Homo sapiens
ENLYEGLNLDDCSMYEDISRG

SEQ ID NO: 7501 - protein, 84 aa, Homo sapiens; identical to SEQ ID NO: 501

SEQ ID NO: 7502 - protein, 84 aa, Homo sapiens; identical to SEQ ID NO: 502

SEQ ID NO: 7503 - protein, 47 aa, Homo sapiens; identical to SEQ ID NO: 503

SEQ ID NO: 7504 - protein, 41 aa, Homo sapiens; identical to SEQ ID NO: 504

SEQ ID NO: 7505 - protein, 47 aa, Homo sapiens; identical to SEQ ID NO: 505

SEQ ID NO: 7506 - protein, 20 aa, Homo sapiens
RPRRSPAQDGKVYINMPGRG

SEQ ID NO: 7507 - protein, 113 aa, Homo sapiens; identical to SEQ ID NO: 507

SEQ ID NO: 7508 - protein, 112 aa, Homo sapiens; identical to SEQ ID NO: 508

SEQ ID NO: 7509 - protein, 102 aa, Homo sapiens; identical to SEQ ID NO: 509

SEQ ID NO: 7510 - protein, 101 aa, Homo sapiens; identical to SEQ ID NO: 510

SEQ ID NO: 7511 - protein, 113 aa, Homo sapiens; identical to SEQ ID NO: 507

SEQ ID NO: 7512 - protein, 112 aa, Homo sapiens; identical to SEQ ID NO: 508

SEQ ID NO: 7513 - protein, 102 aa, Homo sapiens; identical to SEQ ID NO: 509

SEQ ID NO: 7514 - protein, 101 aa, Homo sapiens; identical to SEQ ID NO: 510

SEQ ID NO: 7515 - protein, 21 aa, Homo sapiens
ESPYQELQGQRSDVYSDLNTQ

SEQ ID NO: 7516 - protein, 49 aa, Homo sapiens; identical to SEQ ID NO: 517

SEQ ID NO: 7517 - protein, 35 aa, Homo sapiens; identical to SEQ ID NO: 518

SEQ ID NO: 7518 - protein, 39 aa, Homo sapiens; identical to SEQ ID NO: 519

SEQ ID NO: 7519 - protein, 149 aa, Homo sapiens; identical to SEQ ID NO: 520

SEQ ID NO: 7520 - protein, 619 aa, Homo sapiens; identical to SEQ ID NO: 521

SEQ ID NO: 7521 - protein, 180 aa, Homo sapiens; identical to SEQ ID NO: 522

SEQ ID NO: 7522 - protein, 240 aa, Homo sapiens; identical to SEQ ID NO: 523

SEQ ID NO: 7523 - protein, 86 aa, Homo sapiens; identical to SEQ ID NO: 524

SEQ ID NO: 7524 - protein, 21 aa, Homo sapiens
DGVYTGLSTRNQETYETLKHE

SEQ ID NO: 7525 - protein, 66 aa, Homo sapiens; identical to SEQ ID NO: 526

SEQ ID NO: 7526 - protein, 40 aa, Artificial Sequence; identical to SEQ ID NO: 451
  Description of Artificial Sequence: Synthetic polypeptide

SEQ ID NO: 7527 - protein, 67 aa, Homo sapiens; identical to SEQ ID NO: 1024

SEQ ID NO: 7528 - protein, 84 aa, Homo sapiens; identical to SEQ ID NO: 501

SEQ ID NO: 7529 - protein, 219 aa, Artificial Sequence; identical to SEQ ID NO: 1026
  Description of Artificial Sequence: Synthetic polypeptide

SEQ ID NO: 7530 - protein, 283 aa, Artificial Sequence; identical to SEQ ID NO: 1027
  Description of Artificial Sequence: Synthetic polypeptide

SEQ ID NO: 7531 - protein, 46 aa, Homo sapiens; identical to SEQ ID NO: 528

SEQ ID NO: 7532 - protein, 31 aa, Homo sapiens; identical to SEQ ID NO: 529

SEQ ID NO: 7533 - protein, 27 aa, Homo sapiens
IISFFLALTSTALLFLLFFLTLRFSVV

SEQ ID NO: 7534 - protein, 26 aa, Homo sapiens
VAAILGLGLVLGLLGPLAILLALYLL

SEQ ID NO: 7535 - protein, 363 aa, Homo sapiens; identical to SEQ ID NO: 532

SEQ ID NO: 7536 - protein, 21 aa, Homo sapiens
AVFGCIFGALVIVTVGGFIFW

SEQ ID NO: 7537 - protein, 185 aa, Homo sapiens; identical to SEQ ID NO: 534

SEQ ID NO: 7538 - protein, 106 aa, Homo sapiens; identical to SEQ ID NO: 535

SEQ ID NO: 7539 - protein, 27 aa, Homo sapiens
FWVLVVVGGVLACYSLLVTVAFIIFWV

SEQ ID NO: 7540 - protein, 66 aa, Homo sapiens; identical to SEQ ID NO: 537

SEQ ID NO: 7541 - protein, 33 aa, Homo sapiens; identical to SEQ ID NO: 538

SEQ ID NO: 7542 - protein, 68 aa, Homo sapiens; identical to SEQ ID NO: 449

SEQ ID NO: 7543 - protein, 28 aa, Homo sapiens
MFWVLVVVGGVLACYSLLVTVAFIIFWV

SEQ ID NO: 7544 - protein, 26 aa, Homo sapiens
FWVLVVVGGVLACYSLLVTVAFHFWV

SEQ ID NO: 7545 - protein, 28 aa, Homo sapiens
MFWVLVVVGGVLACYSGGVTVAFIIFWV

SEQ ID NO: 7546 - protein, 26 aa, Homo sapiens
WVLVVVGGVLACYSLLVTVAFIIFWV

SEQ ID NO: 7547 - protein, 69 aa, Homo sapiens; identical to SEQ ID NO: 544

SEQ ID NO: 7548 - protein, 180 aa, Homo sapiens; identical to SEQ ID NO: 545

SEQ ID NO: 7549 - protein, 216 aa, Homo sapiens; identical to SEQ ID NO: 546

SEQ ID NO: 7550 - protein, 140 aa, Homo sapiens; identical to SEQ ID NO: 547

SEQ ID NO: 7551 - protein, 222 aa, Homo sapiens; identical to SEQ ID NO: 454

SEQ ID NO: 7552 - protein, 23 aa, Homo sapiens
LCYLLDGILFIYGVILTALFLRV

SEQ ID NO: 7553 - protein, 51 aa, Homo sapiens; identical to SEQ ID NO: 550

SEQ ID NO: 7554 - protein, 21 aa, Homo sapiens
LCYLLDGILFIYGVILTALFL

SEQ ID NO: 7555 - protein, 25 aa, Homo sapiens
ALIVLGGVAGLLLFIGLGIFFCVRC

SEQ ID NO: 7556 - protein, 22 aa, Homo sapiens
MALIVLGGVAGLLLFIGLGIFF

SEQ ID NO: 7557 - protein, 725 aa, Homo sapiens; identical to SEQ ID NO: 554

SEQ ID NO: 7558 - protein, 23 aa, Homo sapiens
PLFIPVAVMVTAFSGLAFIIWLA

SEQ ID NO: 7559 - protein, 24 aa, Homo sapiens
ALPAALAVISFLLGLGLGVACVLA

SEQ ID NO: 7560 - protein, 21 aa, Homo sapiens
MALPVTALLLPLALLLHAARP

SEQ ID NO: 7561 - protein, 286 aa, Homo sapiens; identical to SEQ ID NO: 558

SEQ ID NO: 7562 - protein, 226 aa, Homo sapiens; identical to SEQ ID NO: 559

SEQ ID NO: 7563 - protein, 83 aa, Homo sapiens; identical to SEQ ID NO: 560

SEQ ID NO: 7564 - protein, 22 aa, Homo sapiens
IWAPLAGTCGVLLLSLVITLYC

SEQ ID NO: 7565 - protein, 24 aa, Homo sapiens
IYIWAPLAGTCGVLLLSLVITLYC

SEQ ID NO: 7566 - protein, 25 aa, Homo sapiens
IYIWAPLAGTCGVLLLSLVITLYCR

SEQ ID NO: 7567 - protein, 25 aa, Homo sapiens
IYIWAPLAGTCGVLLLSLVITLVCR

SEQ ID NO: 7568 - protein, 21 aa, Homo sapiens
IYIWAPLAGTCGVLLLSLVIT

SEQ ID NO: 7569 - protein, 23 aa, Homo sapiens
IYIWAPLAGTCGVLLLSLVITLY

SEQ ID NO: 7570 - protein, 23 aa, Homo sapiens
LGLLVAGVLVLLVSLGVAIHLCC

SEQ ID NO: 7571 - protein, 101 aa, Homo sapiens; identical to SEQ ID NO: 568

SEQ ID NO: 7572 - protein, 257 aa, Homo sapiens; identical to SEQ ID NO: 570

SEQ ID NO: 7573 - protein, 54 aa, Homo sapiens; identical to SEQ ID NO: 573

SEQ ID NO: 7574 - protein, 31 aa, Homo sapiens; identical to SEQ ID NO: 574

SEQ ID NO: 7575 - protein, 24 aa, Homo sapiens
SIISAVVGILLVVVLGVVFGILII

SEQ ID NO: 7576 - protein, 113 aa, Homo sapiens; identical to SEQ ID NO: 576

SEQ ID NO: 7577 - protein, 21 aa, Homo sapiens
FWLPIGCAAFVVVCILGCILI

SEQ ID NO: 7578 - protein, 233 aa, Homo sapiens; identical to SEQ ID NO: 585

SEQ ID NO: 7579 - protein, 21 aa, Homo sapiens
VAAILGLGLVLGLLGPLAILL

SEQ ID NO: 7580 - protein, 24 aa, Homo sapiens
IYIWAPLAGTCGVLLLSLVITLYC

SEQ ID NO: 7581 - protein, 24 aa, Homo sapiens
IYIWAPLAGTCGVLLLSLVITLYC

SEQ ID NO: 7582 - protein, 5 aa, Homo sapiens
DKTHT

SEQ ID NO: 7583 - protein, 4 aa, Homo sapiens
CPPC

SEQ ID NO: 7584 - protein, 15 aa, Homo sapiens
CPEPKSCDTPPPCPR

SEQ ID NO: 7585 - protein, 12 aa, Homo sapiens
ELKTPLGDTTHT

SEQ ID NO: 7586 - protein, 10 aa, Homo sapiens
KSCDKTHTCP

SEQ ID NO: 7587 - protein, 16 aa, Homo sapiens
LDPKSSDKTHTCPPCP

SEQ ID NO: 7588 - protein, 39 aa, Homo sapiens; identical to SEQ ID NO: 599

SEQ ID NO: 7589 - protein, 12 aa, Homo sapiens
GGAVHTRGLDFA

SEQ ID NO: 7590 - protein, 45 aa, Homo sapiens; identical to SEQ ID NO: 601

SEQ ID NO: 7591 - protein, 48 aa, Homo sapiens; identical to SEQ ID NO: 602

SEQ ID NO: 7592 - protein, 79 aa, Homo sapiens; identical to SEQ ID NO: 605

SEQ ID NO: 7593 - protein, 51 aa, Homo sapiens; identical to SEQ ID NO: 606

SEQ ID NO: 7594 - protein, 69 aa, Homo sapiens; identical to SEQ ID NO: 607

SEQ ID NO: 7595 - protein, 44 aa, Homo sapiens; identical to SEQ ID NO: 608

SEQ ID NO: 7596 - protein, 47 aa, Homo sapiens; identical to SEQ ID NO: 609

SEQ ID NO: 7597 - protein, 11 aa, Homo sapiens
LDKTHTCPPCP

SEQ ID NO: 7598 - protein, 101 aa, Homo sapiens; identical to SEQ ID NO: 568

SEQ ID NO: 7599 - protein, 16 aa, Homo sapiens
GLAVSTISSFFPPGYQ

SEQ ID NO: 7600 - protein, 282 aa, Homo sapiens; identical to SEQ ID NO: 614

SEQ ID NO: 7601 - protein, 246 aa, Homo sapiens; identical to SEQ ID NO: 615

SEQ ID NO: 7602 - protein, 45 aa, Homo sapiens; identical to SEQ ID NO: 616

SEQ ID NO: 7603 - protein, 16 aa, Homo sapiens
LEPKSCDKTHTCPPCP

SEQ ID NO: 7604 - protein, 43 aa, Homo sapiens; identical to SEQ ID NO: 618

SEQ ID NO: 7605 - protein, 16 aa, Homo sapiens
ELKTPLGDTHTCPRCP

SEQ ID NO: 7606 - protein, 15 aa, Homo sapiens
EPKSCDTPPPCPRCP

SEQ ID NO: 7607 - protein, 12 aa, Homo sapiens
ESKYGPPCPSCP

SEQ ID NO: 7608 - protein, 12 aa, Homo sapiens
ERKCCVECPPCP

SEQ ID NO: 7609 - protein, 229 aa, Homo sapiens; identical to SEQ ID NO: 624

SEQ ID NO: 7610 - protein, 119 aa, Homo sapiens; identical to SEQ ID NO: 625

SEQ ID NO: 7611 - protein, 282 aa, Homo sapiens; identical to SEQ ID NO: 614

SEQ ID NO: 7612 - protein, 281 aa, Homo sapiens; identical to SEQ ID NO: 627

SEQ ID NO: 7613 - protein, 283 aa, Homo sapiens; identical to SEQ ID NO: 628

SEQ ID NO: 7614 - protein, 58 aa, Homo sapiens; identical to SEQ ID NO: 629

SEQ ID NO: 7615 - protein, 282 aa, Homo sapiens; identical to SEQ ID NO: 614

SEQ ID NO: 7616 - protein, 282 aa, Homo sapiens; identical to SEQ ID NO: 614

SEQ ID NO: 7617 - protein, 281 aa, Homo sapiens; identical to SEQ ID NO: 1117

SEQ ID NO: 7618 - protein, 282 aa, Homo sapiens; identical to SEQ ID NO: 614

SEQ ID NO: 7619 - protein, 234 aa, Homo sapiens; identical to SEQ ID NO: 635

SEQ ID NO: 7620 - protein, 20 aa, Homo sapiens
AEPKSPDKTHTCPPCPKDPK

SEQ ID NO: 7621 - protein, 233 aa, Homo sapiens; identical to SEQ ID NO: 638

SEQ ID NO: 7622 - protein, 13 aa, Homo sapiens
SVFLFPPKPKDTL

SEQ ID NO: 7623 - protein, 231 aa, Homo sapiens; identical to SEQ ID NO: 640

SEQ ID NO: 7624 - protein, 235 aa, Homo sapiens; identical to SEQ ID NO: 641

SEQ ID NO: 7625 - protein, 223 aa, Homo sapiens; identical to SEQ ID NO: 642

SEQ ID NO: 7626 - protein, 235 aa, Homo sapiens; identical to SEQ ID NO: 643

SEQ ID NO: 7627 - protein, 17 aa, Homo sapiens
ELKTPLGDTTHTCPRCP

SEQ ID NO: 7628 - protein, 61 aa, Homo sapiens; identical to SEQ ID NO: 646

SEQ ID NO: 7629 - protein, 230 aa, Homo sapiens; identical to SEQ ID NO: 647

SEQ ID NO: 7630 - protein, 230 aa, Homo sapiens; identical to SEQ ID NO: 648

SEQ ID NO: 7631 - protein, 12 aa, Homo sapiens
SPNMVPHAHHAQ

SEQ ID NO: 7632 - protein, 107 aa, Homo sapiens; identical to SEQ ID NO: 650

SEQ ID NO: 7633 - protein, 129 aa, Homo sapiens; identical to SEQ ID NO: 651

SEQ ID NO: 7634 - protein, 229 aa, Homo sapiens; identical to SEQ ID NO: 652

SEQ ID NO: 7635 - protein, 229 aa, Homo sapiens; identical to SEQ ID NO: 653

SEQ ID NO: 7636 - DNA, 36 bp, Homo sapiens; identical to SEQ ID NO: 655

SEQ ID NO: 7637 - protein, 12 aa, Homo sapiens
ESKYGPPCPPCP

SEQ ID NO: 7638 - protein, 9 aa, Homo sapiens
YGPPCPPCP

SEQ ID NO: 7639 - protein, 10 aa, Homo sapiens
KYGPPCPPCP

SEQ ID NO: 7640 - protein, 13 aa, Homo sapiens
EVVKYGPPCPPCP

SEQ ID NO: 7641 - protein, 229 aa, Homo sapiens; identical to SEQ ID NO: 664

SEQ ID NO: 7642 - protein, 22 aa, Homo sapiens
ESKYGPPCPPCPGGGSSGGGSG

SEQ ID NO: 7643 - protein, 231 aa, Homo sapiens; identical to SEQ ID NO: 666

SEQ ID NO: 7644 - protein, 231 aa, Homo sapiens; identical to SEQ ID NO: 667

SEQ ID NO: 7645 - protein, 236 aa, Homo sapiens; identical to SEQ ID NO: 1145

SEQ ID NO: 7646 - protein, 268 aa, Artificial Sequence; identical to SEQ ID NO: 1146
  Description of Artificial Sequence: Synthetic Construct

SEQ ID NO: 7647 - protein, 153 aa, Artificial Sequence; identical to SEQ ID NO: 1147
  Description of Artificial Sequence: Synthetic Construct

SEQ ID NO: 7648 - protein, 319 aa, Artificial Sequence; identical to SEQ ID NO: 1148
  Description of Artificial Sequence: Synthetic Construct

SEQ ID NO: 7649 - protein, 528 aa, Artificial Sequence; identical to SEQ ID NO: 1149
  Description of Artificial Sequence: Synthetic Payload

SEQ ID NO: 7650 - protein, 579 aa, Artificial Sequence; identical to SEQ ID NO: 1150
  Description of Artificial Sequence: Synthetic Payload

SEQ ID NO: 7651 - protein, 607 aa, Artificial Sequence; identical to SEQ ID NO: 1151
  Description of Artificial Sequence: Synthetic Payload

SEQ ID NO: 7652 - protein, 607 aa, Artificial Sequence; identical to SEQ ID NO: 1152
  Description of Artificial Sequence: Synthetic Payload

SEQ ID NO: 7653 - protein, 607 aa, Artificial Sequence; identical to SEQ ID NO: 1153
  Description of Artificial Sequence: Synthetic Payload

SEQ ID NO: 7654 - protein, 413 aa, Artificial Sequence; identical to SEQ ID NO: 1154
  Description of Artificial Sequence: Synthetic Payload

SEQ ID NO: 7655 - protein, 525 aa, Artificial Sequence; identical to SEQ ID NO: 1155
  Description of Artificial Sequence: Synthetic Payload

SEQ ID NO: 7656 - protein, 576 aa, Artificial Sequence; identical to SEQ ID NO: 1156
  Description of Artificial Sequence: Synthetic Payload

(The sequence listing continues in the following parts.)

What is claimed is:

1. A biocircuit system comprising at least one effector module, said effector module comprising
    (a) a stimulus response element (SRE) and
    (b) at least one payload, said payload comprising a protein of interest which is fused to said SRE, wherein said SRE comprises a destabilizing domain (DD), said DD comprising a human dihydrofolate reductase (hDHFR) mutant selected from the group consisting of a hDHFR comprising the amino acid sequence of SEQ ID NO. 6445; a hDHFR comprising the amino acid sequence of SEQ ID NO. 6447; a hDHFR comprising the amino acid sequence of SEQ ID NO. 6451; a hDHFR comprising the amino acid sequence of SEQ ID NO. 6452; a hDHFR comprising the amino acid sequence of SEQ ID NO. 6453; a hDHFR comprising the amino acid sequence of SEQ ID NO. 6454; and a hDHFR comprising the amino acid sequence of SEQ ID NO. 6469.

2. The biocircuit system of claim 1, wherein the effector module is responsive to one or more stimuli, and wherein said one or more stimuli is Trimethoprim (TMP) or Methotrexate (MTX).

3. The biocircuit system of claim 1, wherein the payload is an immunotherapeutic agent.

4. The biocircuit system of claim 3, wherein the immunotherapeutic agent is a cytokine, a cytokine-cytokine receptor fusion protein, a chimeric antigen receptor (CAR), or combinations thereof.

5. The biocircuit system of claim 4, wherein the immunotherapeutic agent is a chimeric antigen receptor (CAR) that comprises
    (a) an extracellular target moiety;
    (b) a transmembrane domain;
    (c) an intracellular signaling domain; and
    (d) optionally, one or more co-stimulatory domains.

6. The biocircuit system of claim 5, wherein the extracellular target moiety is a scFv derived from an antibody that specifically binds a CD19 antigen.

7. The biocircuit system of claim 3, wherein the immunotherapeutic agent is a cytokine.

8. The biocircuit system of claim 7, wherein the cytokine is an interleukin, an interferon, a tumor necrosis factor, a transforming growth factor B, a CC chemokine, a CXC chemokine, a CX3C chemokine or a growth factor.

9. An effector module comprising a hDHFR-derived SRE fused to a payload, wherein the hDHFR-derived SRE is a hDHFR mutant selected from the group consisting of a hDHFR comprising the amino acid sequence of SEQ ID NO. 6445; a hDHFR comprising the amino acid sequence of SEQ ID NO. 6447; a hDHFR comprising the amino acid sequence of SEQ ID NO. 6451; a hDHFR comprising the amino acid sequence of SEQ ID NO. 6452; a hDHFR comprising the amino acid sequence of SEQ ID NO. 6453; a hDHFR comprising the amino acid sequence of SEQ ID NO. 6454; and a hDHFR comprising the amino acid sequence of SEQ ID NO. 6469.

10. The effector module of claim 9, wherein the payload is a natural protein or a variant thereof or a therapeutic agent.

11. The effector module of claim 10, further comprising a signal peptide, a regulatory sequence, a linker, a label, and/or a protein cleavage site.

12. A polynucleotide encoding a biocircuit of claim 1.

13. The polynucleotide of claim 12, wherein the polynucleotide encodes at least one additional feature selected from a promoter, a linker, a signal peptide, a tag, a cleavage site and a targeting peptide.

14. A vector comprising a polynucleotide of claim 12.

15. The vector of claim 14, wherein the vector is a viral vector, or a plasmid.

16. The vector of claim 15, wherein the vector is a viral vector and said viral vector is a retroviral vector, a lentiviral vector, a gamma retroviral vector, a recombinant AAV vector, an adeno viral vector, or an oncolytic viral vector.

17. An isolated immune cell for adoptive cell transfer (ACT), which expresses the biocircuit of claim 1.

18. The isolated immune cell of claim 17, wherein the immune cell is a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell or a mixture thereof.

19. A pharmaceutical composition comprising the biocircuit of claim 1 and a pharmaceutically acceptable excipient.

20. An isolated immune cell for adoptive cell transfer (ACT) that expresses the polynucleotide of claim 12.

21. The isolated immune cell of claim 20, wherein the immune cell is a CD8+ T cell, a CD4+ T cell, a helper T cell, a natural killer (NK) cell, a NKT cell, a cytotoxic T lymphocyte (CTL), a tumor infiltrating lymphocyte (TIL), a memory T cell, a regulatory T (Treg) cell, a cytokine-induced killer (CIK) cell, a dendritic cell or a mixture thereof.

22. An isolated immune cell for adoptive cell transfer (ACT) that is infected or transfected with the vector of claim 14.

23. A pharmaceutical composition comprising the polynucleotide of claim 12, and a pharmaceutically acceptable excipient.

24. A pharmaceutical composition comprising the immune cell of claim 20, and a pharmaceutically acceptable excipient.

25. A polynucleotide encoding the effector module of claim 9.

26. An isolated immune cell for adoptive cell transfer (ACT), which expresses the effector module of claim 9.

27. A pharmaceutical composition comprising the effector module of claim 9, and a pharmaceutically acceptable excipient.

28. The effector module of claim 10, wherein the natural protein or variant thereof is a fusion polypeptide, or an antibody or a fragment thereof.

29. The effector module of claim 10, wherein the therapeutic agent is an immunotherapeutic agent, or a gene therapy agent.

* * * * *

UNITED STATES PATENT AND TRADEMARK OFFICE
CERTIFICATE OF CORRECTION

PATENT NO. : 11,629,340 B2
APPLICATION NO. : 16/558224
DATED : April 18, 2023
INVENTOR(S) : Vipin Suri et al.

It is certified that error appears in the above-identified patent and that said Letters Patent is hereby corrected as shown below:

On the Title Page

Related U.S. Application Data (63)
Delete:
"Continuation of application No. PCT/US2018/020718, filed on Mar.2,2018, which is a continuation of application No. PCT/US2018/020741, filed on Mar.2,2018, which is a continuation of application No. PCT/US2018/020755, filed on Mar.2,2018, which is a continuation of application No. PCT/US2018/020768, filed on Mar.2,2018, which is a continuation of application No. PCT/US2018/020704, filed on Mar.2,2018."
And Insert:
--Continuation of application No. PCT/US2018/020718, filed on Mar. 2, 2018, and is a continuation of application No. PCT/US2018/020741, filed on Mar. 2, 2018, and is a continuation of application No. PCT/US2018/020755, filed on Mar. 2, 2018, and is a continuation of application No. PCT/US2018/020768, filed on Mar. 2, 2018, and is a continuation of application No. PCT/US2018/020704, filed on Mar. 2, 2018.--

Signed and Sealed this
Seventeenth Day of October, 2023

Katherine Kelly Vidal
*Director of the United States Patent and Trademark Office*